(12) United States Patent
Giot et al.

(10) Patent No.: US 6,753,314 B1
(45) Date of Patent: Jun. 22, 2004

(54) PROTEIN-PROTEIN COMPLEXES AND METHODS OF USING SAME

(75) Inventors: Loic Giot, East Haven, CT (US); Traci A. Mansfield, Bramford, CT (US)

(73) Assignee: CuraGen Corporation, New Haven, CT (US)

( * ) Notice: Subject to any disclaimer, the term of this patent is extended or adjusted under 35 U.S.C. 154(b) by 0 days.

(21) Appl. No.: 09/538,092

(22) Filed: Mar. 29, 2000

Related U.S. Application Data

(60) Provisional application No. 60/178,965, filed on Feb. 1, 2000, and provisional application No. 60/127,352, filed on Apr. 1, 1999.

(51) Int. Cl.$^7$ ..................... C07K 14/395; C12N 15/10
(52) U.S. Cl. ................... 514/12; 530/350; 536/23.5; 435/254.21; 435/320.1; 435/252.3; 435/7.1; 435/69.7
(58) Field of Search ................... 514/12; 530/350; 536/23.5; 435/254.21, 320.1, 252.3, 7.1, 69.7

(56) References Cited

FOREIGN PATENT DOCUMENTS

| | | |
|---|---|---|
| WO | WO 99/35256 | 7/1999 |
| WO | WO 00/46406 | 8/2000 |

OTHER PUBLICATIONS

Aneskievich, B. J. and E. Fuchs (1995). "The A/B domain of truncated retinoic acid receptors can block differentiation and promote features of malignancy." *J Cell Sci* 108(Pt 1): 195–205.

Bishop, D. K., Park, et al. (1992). "DMC1: a meiosis–specific yeast homolog of E. coli recA required for recombination, synaptonemal complex formation, and cell cycle progression." *Cell* 69(3): 439–56.

Cvrckova, F. and K. Nasmyth (1993). "Yeast G1 cyclins CLN1 and CLN2 and a GAP–like protein have a role in bud formation." *Embo J* 12(13): 5277–86.

Fabre, E. and E. Hurt (1997). "Yeast genetics to dissect the nuclear pore complex and nucleocytoplasmic trafficking." *Annu Rev Genet* 31: 277–313.

Funakoshi, T., A. Matsuura, et al. (1997). "Analyses of APG13 gene involved in autophagy in yeast, *Saccharomyces cerevisiae*." *Gene* 192(2): 207–13.

Genbank Accession No.: AB007948.

Hollingsworth, N. M., L. Ponte, et al. (1995). "MSH5, a novel MutS homolog, facilitates meiotic reciprocal recombination between homologs in *Saccharomyces cerevisiae* but not mismatch repair." *Genes Dev* 9(14): 1728–39.

Hoyt, M. A., L. Totis, et al. (1991). "*S. cerevisiae* genes required for cell cycle arrest in response to loss microtubule function." *Cell* 66(3): 507–17.

Hwang, L. H., L. F. Lau, et al. (1998). "Budding yeast Cdc20: a target of the spindle checkpoint [see comments] [published erratum appears in Science May 29, 1998;280(5368):1331]." *Science* 279(5353): 1041–4.

Kessler, M. M., M. F. Henry, et al. (1997). "Hrp1, a sequence–specific RNA–binding protein that shuttles between the nucleus and the cytoplasm, is required for mRNA 3'–end formation in yeast." *Genes Dev* 11(19): 2545–56.

Kim, J., S. V. Scott, et al. (1997). "Transport of a large oligomeric protein by the cytoplasm to vacuole protein targeting pathway." *J Cell Biol* 137(3): 609–18.

Nasmyth, K. (1993). "Control of the yeast cell cycle by the Cdc28 protein kinase." *Curr Opin Cell Biol* 5(2): 166–79.

Saul, D. J. and P. E. Sudbery (1985), "Molecular cloning of WH12, a gene involved in the regulation of cell proliferation in *Saccharomyces cerevisiae*." *J Gen Microbiol* 131(Pt 7): 1797–806.

Scott, S. V., A. Hefner–Gravink, et al. (1996). "Cytoplasm–to–vacuole targeting and autophagy employ the same machinery to deliver proteins to the yeast vacuole." *Proc Natl Acad Sci U S A* 93(22): 12304–8.

Scott, S. V. and D. J. Klionsky (1998). "Delivery of proteins and organelles to the vacuole from the cytoplasm." *Curr Opin Cell Biol* 10(4): 523–9.

Singer–Kruger, B., H. Stenmark, et al. (1994). "Role of three rab5–like GTPases, Ypt51p, Ypt52p, and Ypt53p, in the endocytic and vacuolar protein sorting pathways of yeast." *J Cell Biol* 125(2): 283–98.

Taylor, S. S., E. Ha, et al. (1998). "The human homologue of Bub3 is required for kinetochore localization of Bub1 and a Mad3/Bub1–related protein kinase." *J Cell Biol* 142(1): 1–11.

Thumm, M., R. Egner, et al. (1994). "Isolation of autophagocytosis mutants of *Saccharomyces cerevisiae*." *FEBS Lett* 349(2): 275–80.

Tsukada, M. and Y. Ohsumi (1993). "Isolation and characterization of autophagy–defective mutants of *Saccharomyces cerevisiae*." *FEBS Lett* 333(1–2): 169–74.

Usui, T., T. Ohta, et al. (1998). "Complex formation and functional versatility of Mre11 of budding yeast in recombination." *Cell* 95(5): 705–16.

(List continued on next page.)

*Primary Examiner*—Karen Cochrane Carlson
*Assistant Examiner*—Chih-Min Kam
(74) *Attorney, Agent, or Firm*—Ivor R. Elrifi, Esq.; Mintz, Levin, Cohn, Ferris, Glovsky & Popeo, P.C.

(57) ABSTRACT

The invention provides complexes of at least two polypeptides, and methods of using the same. Purified complexes of two polypeptides are provided, including chimeric complexes, and chimeric polypeptides and complexes thereof are also provided, as are nucleic acids encoding chimeric polypeptides and vectors and cells containing the same. Also provided are methods of identifying agents that disrupt polypeptide complexes, methods of identifying complex or polypeptide in a sample, and for removing the same, methods of determining altered expression of a polypeptide in a subject, and methods of treating/preventing disorders involving altered levels of complex or polypeptide.

5 Claims, No Drawings

OTHER PUBLICATIONS

Wigge, P. A., O. N. Jensen, et al. (1998). "Analysis of the Saccharomyces spindle pole by matrix–assisted laser desorption/ionization (MALDI) mass spectrometry." *J Cell Biol* 141(4): 967–77.

Uetz et al., (2000). "A comprehensive analysis of protein–protein interactions in *Saccharomyces cerevisiae*." *Nature* 403: 623–631.

Fromont–Racine, M. et al. (1997). *Nature Genetics 16*: 277–282.

Wodicka, L. et al. (1997). *Nature Biotech. 15*: 1359–1367.

Lecrenier, N. et al. (1998). *Bioessays 20*: 1–5.

Bendixen, C. et al. (1994). *Nuc. Acids Res. 22*:1778–1779.

Luo, Y. et al. (1996). *Biotechniques 20*: 564–568.

Cho, R. et al. (1998). *Proc. of the Natl. Acad. Sci. USA 95*: 3752–3757.

Flores, A. et al. (1999). *Proc. of the Natl. Acad. Sci. USA 96*:7815–7820.

International Search Report, issued Sep. 19, 2000.

US 6,753,314 B1

PROTEIN-PROTEIN COMPLEXES AND METHODS OF USING SAME

RELATED APPLICATIONS

This application claims priority from U.S. Ser. No. 60/127,352, filed Apr. 1, 1999, and U.S. Ser. No. 60/178,965, filed Feb. 1, 2000 ("Human Ortholog Protein Interactions of Yeast Interactions"). The contents of these applications are incorporated by reference in their entirety.

FIELD OF THE INVENTION

The invention relates generally to polypeptides and complexes of two or more polypeptides, as well as to methods of use thereof.

BACKGROUND OF THE INVENTION

Most, if not all, biologically important activities are mediated at the tissue, cellular, and subcellular level at least in part by interactions between one or more proteins. These biologically important activities can include, e.g., cell division, cell differentiation, anabolic activities, and catabolic activities. Interacting proteins or polypeptides can form a complex. Accordingly, failure to form a given polypeptide complex can result in deleterious consequences to a cell or individual. Conversely, the inappropriate formation of a given polypeptide complex can likewise be undesirable.

The identification of protein complexes associated with specific biological activities can be used to identify or prevent conditions associated with the absence or presence of these complexes.

SUMMARY OF THE INVENTION

The invention is based, in part, upon the identification of protein-protein interactions in the yeast S. cerevisiae and humans. Interacting proteins present in complexes according to the invention are shown in, e.g., Table 3.

In one aspect, the invention provides a purified complex including a first polypeptide that includes the amino acid sequence encoded by the open reading frame ("ORF") listed in Table 3, column 1, and a second polypeptide that includes the amino acid sequence of the corresponding polypeptide encoded by the ORF recited in column 5 of Table 3. Gene names for the ORFs recited in Table 3, column 1, and Table 3, column 5 are provided in Table 3, columns 2 and 6, respectively.

In another aspect, the invention provides a purified complex including a first polypeptide and a second polypeptide selected from, or including, the human polypeptides recited in Table 7, column 2, and the corresponding polypeptides recited in Table 7, column 6. Complexes of polypeptides including the binding domains of such polypeptides, and complexes having labeled polypeptide, are also provided.

The invention also provides purified complexes of a first and a second polypeptide. The first polypeptide is a polypeptide functionally classified in the MIPS database as a Cell/Growth/Cell Division/DNA Synthesis protein; a Cell Rescue/Cell Defense/Cell Death and Aging Protein; a Cellular Biogenesis protein; a Cellular Organization protein; a Classification Not-Yet Clear Cut protein; an Energy Protein; an Intracellular Transport protein; an Ionic Homeostasis protein, a Metabolism protein; a Protein Destination protein; a Protein Synthesis protein; a Retrotransposon/Plasmid protein; a Signal Transduction protein; a Transcription protein; a Transport Facilitation protein, or an Unclassified protein. The second polypeptide is the corresponding polypeptide recited in Table 3, column 5 or Table 7, column 6, respectively.

The invention also provides a purified complex of a first and second polypeptide, where at least one of the polypeptides is a microtubule or microtubule-associated protein, a heme biosynthesis protein, or a cell wall or cell-wall synthesis protein.

The invention further provides purified chimeric complexes including a yeast polypeptide and a human ortholog polypeptide. In some embodiments the yeast polypeptide includes the amino acid sequence of the polypeptides recited in Table 7, column 1, and the human polypeptide includes the amino acid sequence of the corresponding polypeptides recited in Table 7, column 6. In other embodiments the yeast polypeptide is selected from, or includes, the polypeptides recited in Table 7, column 5, and the human ortholog polypeptide is selected from, or includes, the polypeptides recited in Table 7, column 2.

In a further aspect, the invention provides chimeric polypeptides having six or more amino acids of a first polypeptide covalently linked to six or more amino acids of a second polypeptide. In some embodiments, the chimeric polypeptides are yeast-yeast chimeras, while in others the chimeric polypeptides are human-human or yeast-human chimera. In some embodiments, the first polypeptide is selected from the polypeptides recited in Table 3, column 1, and the second polypeptide is selected from the polypeptides recited in Table 3, column 5. In other embodiments, the first polypeptide is selected from polypeptides recited in Table 7, columns 1 or 2, and the second polypeptide is selected from the polypeptides recited in Table 7, columns 5 or 6. Nucleic acids encoding chimeric polypeptides, and vectors and cells containing the same, are also provided.

In yet another aspect, the invention provides an antibody which specifically binds polypeptide complexes according to the invention. The antibody preferably binds to a complex comprising one or more polypeptides with greater affinity than its affinity for either polypeptide that is not present in the complex.

Also provided by the invention are kits containing reagent which can specifically detect the complexes of the invention. In one embodiment, the reagent is a complex-specific antibody, while in other embodiments the reagent is an antibody specific for the first or second polypeptides of the complex.

In another aspect, the invention provides pharmaceutical compositions including the complexes described herein. Such compositions are formulated to be suitable for therapeutic administration in the treatment of deficiencies or diseases involving altered levels of the complexes of the invention.

In still another aspect, the invention provides methods of identifying an agent which disrupts a polypeptide complex by providing a complex described herein, contacting the complex with a test agent, and detecting the presence of a polypeptide displaced from the complex. In certain embodiments, the complex includes at least one polypeptide comprising a microtubule or microtubule-associated protein, a heme biosynthesis protein, or a cell wall or cell-wall synthesis protein.

In a further aspect, the invention provides a method for inhibiting the interaction of a protein with a ligand by contacting a complex of the protein and ligand with an agent that disrupts the complex. In certain embodiments, the protein is a microtubule or microtubule associated protein, a heme biosynthesis protein, or a cell wall or cell-wall synthesis protein, and the ligand is a corresponding interacting polypeptide described herein.

In yet another aspect, the invention provides a method of identifying a polypeptide complex in a subject by providing a biological sample from the subject and detecting, if present, the level of a complex, described herein, in the subject.

Also provided by the invention is a method for detecting a polypeptide in a biological sample by providing a biological sample containing a first polypeptide, and contacting the sample with a second polypeptide under conditions suitable to form a polypeptide complex.

In another aspect, the invention provides a method for removing a first polypeptide from a biological sample by providing a biological sample including the first polypeptide, contacting the sample with a second polypeptide under conditions suitable for formation of a polypeptide complex, and removing the complex, thereby effectively removing the first polypeptide. In certain embodiments, the first polypeptide is selected from, or includes, the polypeptides recited in Table 7, column 2, and the second polypeptide is selected from, or includes, the polypeptides recited in Table 7, column 6. In another embodiment, the first polypeptide is selected from, or includes, the polypeptides recited in Table 7, column 6, and the second polypeptide is selected from, or includes, the polypeptides recited in Table 7, column 2.

In a further aspect, the invention provides a method for determining altered expression of a polypeptide in a subject by providing a biological sample from the subject, measuring the level of polypeptide complex in the sample, and comparing the level of the complex in the sample to the level of complex in a reference sample with a known polypeptide expression level.

In a still further aspect, the invention provides a method of treating or preventing a disease or disorder involving altered levels of a complex described herein or a polypeptide described herein, by administering, to a subject in need thereof, a therapeutically-effective amount of at least one molecule that modulates the function of the complex or polypeptide. In one embodiment, the agent modulates the function of a polypeptide selected from the polypeptides recited in Table 7, columns 2 or 6.

In the specification and the appended claims, the singular forms include plural referents unless the context clearly dictates otherwise. Unless defined otherwise, all technical and scientific terms used herein have the same meaning as commonly understood by one of ordinary skill in the art to which this invention belongs. All patents and publications cited in this specification are incorporated by reference herein in their entirety.

DETAILED DESCRIPTION OF THE INVENTION

The invention provides complexes of interacting polypeptides which have not heretofore been shown to interact directly, as well as methods of using these complexes.

Some interacting polypeptides were identified by identifying which of the predicted open-reading frames (ORFs) of the yeast S. cerevisiae encode polypeptides that interact in a yeast two-hybrid system. In one screen, 692 discrete interacting protein pairs were discovered. These interacting pairs include (i) interactions that place functionally unclassified proteins in a biological context, (ii) novel interactions between proteins involved in the same biological function, and (iii) novel interactions that link together biological functions into larger cellular processes.

A summary of the screening used to identify interacting yeast ORFS is shown in Table 1.

TABLE 1

Screen Summary

| Description | Total |
|---|---|
| Yeast ORF PCR Products | 6144 |
| Yeast ORFs cloned[a] | 5345 |
| ORFs pooled to generate the activation domain library | 5341[b] |
| Yeast ORFs identified to have interactions[c] | 817 |
| Total discrete interacting protein pairs | 692 |
| Interactions identified in independent experiments[d] | 286 |
| Interactions identified multiple times in a single experiment | 186 |
| Interactions identified only once | 220 |

[a]Number of PCR products giving transformants in both plasmids (pOBD2 and pOAD).
[b]One yeast ORF activation domain construct was excluded from the pool due to self-activation in a test screen (YJR009C - glyceraldehyde-3-phosphate dehydrogenase and YNL333W - Snz2) and three yeast ORF activation domain constructs were excluded because they encoded proteins that could affect the selection process (YPL248C - Gal4, YML051W - Gal80 and YEL021W - Ura3).
[c]The total number of yeast ORFs found as an interacting binding domain clone and/or an interacting activation domain clone in the screens.
[d]All screening experiments were performed in duplicate.

Table 2 indicates that the interacting proteins disclosed herein can be grouped by functional roles using the Munich Information Center for Protein Sequences ("MIPS") classification system.

TABLE 2

Interactions grouped by Protein Functional Roles (as classified by the MIPS database)[a]

| MIPS classification | MIPS Classification Proteins in Category[b] | Results from the screen | | |
|---|---|---|---|---|
| | | Proteins with Interactions[c] | Total Interactions | Interactions within a Category |
| Metabolism | 1023 | 133 | 189 | 40 |
| Energy | 239 | 29 | 39 | 3 |
| Cell Growth, Cell Division and DNA Synthesis | 767 | 138 | 227 | 46 |
| Transcription | 734 | 134 | 185 | 38 |
| Protein Synthesis | 345 | 18 | 37 | 5 |
| Protein Destination | 525 | 76 | 98 | 15 |
| Transport Facilitation | 302 | 14 | 20 | 0 |
| Intracellular Transport | 438 | 50 | 99 | 8 |
| Cellular Biogenesis | 185 | 23 | 35 | 3 |
| Signal Transduction | 122 | 25 | 32 | 4 |
| Cell Rescue, Defense, Cell Death and Aging | 341 | 48 | 69 | 7 |
| Ionic Homeostasis | 120 | 8 | 18 | 0 |
| Cellular Organization | 2144 | 290 | 388 | 130 |
| Retrotransposons and Plasmid Proteins[d] | 113 | 1 | 1 | 0 |
| Classification Not Yet Clear-Cut | 151 | 22 | 42 | 1 |
| Unclassified Proteins | 2593 | 313 | 388 | 110 |

[a]In the MIPS database, proteins have been classified into at least one category, and one third of proteins have been placed in more than one category. See MIPS Yeast Genome Database (MYGD) Functional Catalogue [www.mips.biochem.mpg.de/proj/yeast], Mewes et al., Nucl. Acid Res. 25:28 (1997); Mewes et al., Nucl. Acid. Res. 26:33 (1998).
[b]Numbers based on 6234 ORFs.
[c]Total based on 885 ORFs. Total interactions with at least one protein in the category.
[d]Only eight of the yeast ORFs in this category were contained in the original 6144 ORF screening population.

Some newly disclosed interactions place functionally unclassified proteins from the yeast genome in a biological context. For example, two proteins of unknown function, YGR010Wp and YLR328Wp (77% identical), were observed to interact with each other, and also to bind to ornithine aminotransferase (Car2p), which catalyzes a step in arginine metabolism. This observation suggests that YGR010WP and YLR328Wp are implicated in arginine metabolism. In addition, because YGR010Wp and YLR328Wp are 40% identical to the human protein KIAA0479 (Genbank accession number AB007948), the interactive data further suggest that the human protein KIAA0479 is also involved in arginine metabolism.

Also included in the interactions are complexes of two or more proteins involved in functional pathways for which direct interactions have not been described previously. For example, proteins involved in autophagy, e.g., Apg13p, are shown herein to interact with proteins of the Cvt (cytoplasm-to-vacuole targeting) pathway, e.g., Lap4p. Previously, direct interactions between proteins involved in autophagy and the Cvt pathway had not been reported. Autophagy is a degradation pathway used under conditions of nutrient stress to non-selectively recycle cytoplasmic proteins and organelles to their constituent components, while the Cvt pathway is a biosynthetic pathway that transports the vacuolar enzyme aminopeptidase I (API, encoded by LAP4) specifically to the vacuole. See Scott et al., *Curr. Opin. Cell. Biol.* 10: 523 (1998). Several mutants in the Cvt pathway (cvt) and autophagocytosis (aut and apg) are allelic, suggesting that both pathways utilize some of the same molecular components. See Tsukada et al., *FEBS Letters* 333: 169 (1993); Thumm et al., *FEBS Letters* 349: 275 (1994); Harding et al., *J. Cell. Biol.* 131: 17621 (1996); Scott et al., *Proc. Natl. Acad. Sci. USA* 93: 12304 (1996).

A number of ORFs encoding proteins of unknown functions have been identified as components of autophagy. Since several of the genes altered in apg, aut, and cvt mutants have not yet been cloned, ORFs found in these interactions can be examined to determine if they encode any of these altered genes. It has also been shown that Lap4p is a self-interactor, corroborating previous evidence that Lap4p assembles into a dodecamer (see Funakoshi et al., *Gene* 192: 207 (1997)), and the observed interaction between Apg1 and Apg13 lends support to previous genetic evidence suggesting that APG1 is a high-copy suppressor of apg13 (Kim et al, *J. Cell. Biol.* 137: 609 (1997)).

An interaction was also identified between YDR201 Wp and YKR037Cp, two proteins known to be localized to the spindle pole body by mass spectrometry. See Wigge et al., *J. Cell Biol.* 141: 967 (1998). The interaction of these proteins may indicate their involvement in the regulation of mitotic events.

New insights into novel interactions between proteins involved in the same biological function are also provided. For example, the nuclear polyadenylated RNA-binding proteins Nab2p and Nab4p bind to the 3' end of mRNA, but have distinct roles. See Kessler et al., *Genes Dev.* 11: 2545 (1997). Nab2p is required for the regulation of poly(A) tail length and export of mRNA from the nucleus, and Nab4p is essential for the cleavage of pre-mRNA at the correct 3' site. The newly described interaction between Nab2p and Nab4p suggests that they may act in concert.

Similarly, in yeast, diverse cyclins bind to Cdc28p in a coordinated manner to modulate its kinase activity during the cell cycle. The B-type cyclins play a critical role in the induction of bipolar mitotic spindle formation. See Nasmyth, *Curr. Opin. Cell. Biol.* 5: 166 (1993). Each of the B-type cyclins, Clb1p, Clb2p and Clb3p, has presently been observed to form a complex with Cks1p and Cdc28p. The identification of interactions between Cks1p and each of Clb1p, Clb2p and Clb3p, suggests that the kinase activity of Cdc28p could be mediated by cyclin Bs through their interaction with Cks1p.

In another example, Ypt53p, a rab5-like GTPase involved in vacuolar protein sorting and endocytosis, has presently been shown to interact with Siw4p, a putative tyrosine phosphatase which acts in a complex to control nutrient-dependent cell proliferation. See Singer-Kruger et al., *J. Cell. Biol.* 125: 283 (1994); Saul et al., *Gen. Microbiol.* 131: 1797 (1985). One possible explanation for the observed interaction is that Ypt53p senses nutrient availability to coordinate cell cycle progression.

The newly identified protein-protein interactions connect biological functions into larger cellular processes. For example, the nuclear pore complex (NPC), consisting of as many as 50 different subunits, is the macromolecular-conducting channel between the nucleus and the cytoplasm. See Fabre et al., *Ann. Rev. Genet.* 31: 277 (1997); Marelli et al., *J. Cell Biol.* 143: 1813 (1998). Two newly identified NPC components, Nup53p and Nup59p/Asm4p, interact with Ndc1p, a protein required for spindle pole body (SPB) duplication and component of the nuclear envelope. Evidence of a physical interaction between components of the NPC and SPB suggests that these two structures located in the nuclear envelope may coordinate communication between the nucleus and the cytoplasm.

Another interaction involves the meiosis-specific protein, Msh5p, which is required for the resolution of cross-overs during meiosis. Hollingsworth et al., *Genes Dev.* 9: 1728 (1995). Meiotic recombination is initiated by double-strand breaks (DSBs), a prerequisite to cross-over formation that is resolved in a structure called the synaptonemal complex (SC). Mre11p is part of a complex that participates in DSB formation. See Usui et al., *Cell* 95: 705 (1998). It is also known that Tid3p helps form the spindle pole body and interacts with Dmc1p, a protein required for the formation of the SC. See Bishop et al., Cell 69: 439–56 (1992). It has presently been shown that Msh5p interacts with both Mre11p and Tid3p. These novel associations tie DSB formation and the resolution of cross-overs with Msh5p as the linking protein.

Similarly, to exit the cell cycle, cells must undergo a series of checkpoints that monitor correct microtubule and spindle formation. See Guenette et al., *J. Cell. Sci.* 108: 195 (1995). The present invention identifies at least two interactions that tie cycle regulation to microtubule assembly. The first is between a microtubule checkpoint protein, Bub3p and a spindle pole body checkpoint protein, Mad3p. This observation mirrors the recent interaction described between the human homologs of Bub3p and Mad3p. See Hoyt et al., *Cell* 66: 507–17 (1991); Hwang et al., *Science* 279. 1041 (1998); Taylor et al., *J. Cell Biol.* 142: 1 (1998). Interestingly, the second is between Mad3p and a known regulator of the Cdc28p kinase, Cln3p, See Cvrckova et al., *EMBO J.* 12: 5277 (1993). These interactions could give rise to a cascade Bub3→Mad3→Cln3p→Cdc28p, and may suggest a pathway to propagate the signal of incorrect microtubule formation during early events at the cell cycle arrest in G1 phase.

The complexes disclosed herein are useful, inter alia, in identifying agents which modulate cellular processes in which one or more members of the complex have previously been associated. For example, interacting Pro-Pairs 1a–1b (representing open reading frames YGR108W and YBR135W, or genes CLB1 and CKS1, respectively) as shown in Table 3, have both been previously implicated in cell growth, cell division, and/or DNA synthesis.

Accordingly, new agents which modulate cell growth, cell division, and/or DNA synthesis can be identified by evaluating the ability of a test agent to affect formation or dissolution of a complex of the Pro-Pairs 1a and 1b.

Complexes according to the invention can also be used in methods for identifying a desired polypeptides in a biological sample by forming a complex of a first polypeptide and a second polypeptide that interacts with the first polypeptide. The presence of the complex indicates that the sample contains the first polypeptide.

These utilities, as well as additional utilities, are discussed in greater detail below Purified Polypeptide Complexes In one aspect, the invention includes a purified complex that includes two or more polypeptides. In one embodiment, the invention provides purified complexes of two or more polypeptides. One of the polypeptides includes a polypeptide selected from the polypeptides recited in Table 3, column 1 (referenced as ProPair 1a–692a) and another includes a polypeptide selected from the polypeptides recited in Table 3, column 5 (referenced as ProPair 1b–692b). In some embodiments the first and second polypeptides of the complex are the polypeptides enumerated in Table 3. In some embodiments a first polypeptide is listed as a "bait" polypeptide and a second polypeptide is denoted as "prey" polypeptide while in other embodiments the first polypeptide corresponds to a "prey" polypeptide and the second is a "bait" polypeptide.

By "corresponding polypeptide" is meant, with reference to Tables 3–7, the polypeptide recited in the same row, reading across from left-to-right or right-to-left, as a specific selected peptide. For example, in Table 3, in the first row, the corresponding polypeptide of YGR108W is YBR135W. These protein pairs are designated as 1a and 1b, as is indicated in Table 3.

Similarly, in the first row, the corresponding polypeptide of YBR135W (ProPair 1b) is YBR108W. (ProPair 1a). In the second row, however, the corresponding polypeptide of YBR135W (a prey protein; ProPair 2b) is YPR119W (a bait protein; ProPair 2a).

Also as used herein, "protein" and "protein complex" are used synonymously with "polypeptide" and "polypeptide complex." A "purified" polypeptide, protein or biologically active portion thereof is substantially free of cellular material or other contaminating proteins from the cell or tissue source from which the polypeptide is derived, or substantially free from chemical precursors or other chemicals when chemically synthesized. The language "substantially free of cellular material" includes preparations of protein in which the protein is separated from cellular components of the cells from which it is isolated or recombinantly produced. In one embodiment, the language "substantially free of cellular material" includes preparations of polypeptide complex having less than about 30% (by dry weight) of non-complex proteins (also referred to herein as a "contaminating protein"), more preferably less than about 20% of contaminating protein, still more preferably less than about 10% of contaminating protein, and most preferably less than about 5% non-complex protein. When the polypeptide or complex is recombinantly produced, it is also preferably substantially free of culture medium, i.e., culture medium represents less than about 20%, more preferably less than about 10%, and most preferably less than about 5% of the volume of the protein preparation.

TABLE 3

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YGR108W | CLB1 | 1a | Cell Growth, Cell Division And DNA Synthesis; | YBR135W | CKS1 | 1b | Cell Growth, Cell Division And DNA Synthesis; |
| YPR119W | CLB2 | 2a | Cell Growth, Cell Division And DNA Synthesis; | YBR135W | CKS1 | 2b | Cell Growth, Cell Division And DNA Synthesis; |
| YDL155W | CLB3 | 3a | Cell Growth, Cell Division And DNA Synthesis; | YBR135W | CKS1 | 3b | Cell Growth, Cell Division And DNA Synthesis; |
| YDR206W | EBS1 | 4a | Cell Growth, Cell Division And DNA Synthesis; | YJL030W | MAD2 | 4b | Cell Growth, Cell Division And DNA Synthesis; |
| YDR206W | EBS1 | 5a | Cell Growth, Cell Division And DNA Synthesis; | YBR057C | MUM2 | 5b | Cell Growth, Cell Division And DNA Synthesis; |
| YGL175C | SAE2 | 6a | Cell Growth, Cell Division And DNA Synthesis; | YGL175C | SAE2 | 6b | Cell Growth, Cell Division And DNA Synthesis; |
| YGL229C | SAP4 | 7a | Cell Growth, Cell Division And DNA Synthesis; | YJL030W | MAD2 | 7b | Cell Growth, Cell Division And DNA Synthesis; |
| YOR026W | BUB3 | 8a | Cell Growth, Cell Division And DNA Synthesis; | YJL013C | MAD3 | 8b | Cell Growth, Cell Division And DNA Synthesis; Cellular Organization; |
| YGL229C | SAP4 | 9a | Cell Growth, Cell Division And DNA Synthesis; | YJL013C | MAD3 | 9b | Cell Growth, Cell Division And DNA Synthesis; Cellular Organization; |
| YDL127W | PCL2 | 10a | Cell Growth, Cell Division And DNA Synthesis; | YDR146C | SWI5 | 10b | Cell Growth, Cell Division And DNA Synthesis; Transcription; Cellular Organization; |
| YDR108W | GSG1 | 11a | Cell Growth, Cell Division And DNA Synthesis; | YGR234W | YHB1 | 11b | Cell Rescue, Defense, Cell Death And Aging; Cellular Organization; |
| YDR099W | BMH2 | 12a | Cell Growth, Cell Division And DNA Synthesis; | YBL043W | ECM13 | 12b | Cellular Biogenesis; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YOL034W | | 13a | Cell Growth, Cell Division And DNA Synthesis; | YMR117C | | 13b | Cellular Organization; |
| YER180C | ISC10 | 14a | Cell Growth, Cell Division And DNA Synthesis; | YGL026C | TRP5 | 14b | Metabolism; Cellular Organization; |
| YGL229C | SAP4 | 15a | Cell Growth, Cell Division And DNA Synthesis; | YBR196C | PGI1 | 15b | Metabolism; Energy; Cellular Organization; |
| YGL158W | RCK1 | 16a | Cell Growth, Cell Division And DNA Synthesis; | YLR113W | HOG1 | 16b | Metabolism; Signal Transduction; Cell Rescue, Defense, Cell Death And Aging; |
| YDR206W | EBS1 | 17a | Cell Growth, Cell Division And DNA Synthesis; | YER027C | GAL83 | 17b | Metabolism; Transcription; |
| YDR206W | EBS1 | 18a | Cell Growth, Cell Division And DNA Synthesis; | YOR047C | STD1 | 18b | Metabolism; Transcription; |
| YPR119W | CLB2 | 19a | Cell Growth, Cell Division And DNA Synthesis; | YNL135C | FPR1 | 19b | Protein Destination; Cellular Organization; |
| YDR206W | EBS1 | 20a | Cell Growth, Cell Division And DNA Synthesis; | YOL149W | DCP1 | 20b | Transcription; |
| YLR117C | SYF3 | 21a | Cell Growth, Cell Division And DNA Synthesis; | YBR188C | NTC20 | 21b | Transcription; |
| YFL035C | MOB2 | 22a | Cell Growth, Cell Division And DNA Synthesis; | YOL036W | | 22b | Unclassified Proteins; |
| YDR099W | BMH2 | 23a | Cell Growth, Cell Division And DNA Synthesis; | YNL042W | | 23b | Unclassified Proteins; |
| YPR119W | CLB2 | 24a | Cell Growth, Cell Division And DNA Synthesis; | YDR386W | MUS81 | 24b | Unclassified Proteins; |
| YPR119W | CLB2 | 25a | Cell Growth, Cell Division And DNA Synthesis; | YDR412W | | 25b | Unclassified Proteins; |
| YPR119W | CLB2 | 26a | Cell Growth, Cell Division And DNA Synthesis; | YHR035W | | 26b | Unclassified Proteins; |
| YPR119W | CLB2 | 27a | Cell Growth, Cell Division And DNA Synthesis; | YNR022C | | 27b | Unclassified Proteins; |
| YPR046W | MCM16 | 28a | Cell Growth, Cell Division And DNA Synthesis; | YJR135C | MCM22 | 28b | Unclassified Proteins; |
| YOR127W | RGA1 | 29a | Cell Growth, Cell Division And DNA Synthesis; | YHL042W | | 29b | Unclassified Proteins; |
| YOR127W | RGA1 | 30a | Cell Growth, Cell Division And DNA Synthesis; | YJL185C | | 30b | Unclassified Proteins; |
| YGL175C | SAE2 | 31a | Cell Growth, Cell Division And DNA Synthesis; | YCR086W | | 31b | Unclassified Proteins; |
| YGL229C | SAP4 | 32a | Cell Growth, Cell Division And DNA Synthesis; | YJL178C | | 32b | Unclassified Proteins; |
| YGL229C | SAP4 | 33a | Cell Growth, Cell Division And DNA Synthesis; | YJL211C | | 33b | Unclassified Proteins; |
| YGL229C | SAP4 | 34a | Cell Growth, Cell Division And DNA Synthesis; | YMR181C | | 34b | Unclassified Proteins; |
| YGL229C | SAP4 | 35a | Cell Growth, Cell Division And DNA Synthesis; | YOR062C | | 35b | Unclassified Proteins; |
| YGL229C | SAP4 | 36a | Cell Growth, Cell Division And DNA Synthesis; | YPR040W | | 36b | Unclassified Proteins; |
| YMR096W | SNZ1 | 37a | Cell Growth, Cell Division And DNA Synthesis; | YMR095C | SNO1 | 37b | Unclassified Proteins; |
| YHR014W | SPO13 | 38a | Cell Growth, Cell Division And DNA Synthesis; | YHR185C | | 38b | Unclassified Proteins; |
| YLR215C | | 39a | Cell Growth, Cell Division And DNA Synthesis; | YLR386W | | 39b | Unclassified Proteins; |
| YDR076W | RAD55 | 40a | Cell Growth, Cell Division And DNA Synthesis; Cell Rescue, Defense, Cell Death And Aging; Cellular Organization; | YER095W | RAD51 | 40b | Cell Growth, Cell Division And DNA Synthesis; Cell Rescue, Defense, Cell Death And Aging; Cellular Organization; |
| YOR368W | RAD17 | 41a | Cell Growth, Cell Division And DNA Synthesis; Cell Rescue, Defense, Cell Death And Aging; | YLR288C | MEC3 | 41b | Cell Growth, Cell Division And DNA Synthesis; Cellular Biogenesis; Cell Rescue, Defense, Cell Death And Aging; |
| YPL204W | HRR25 | 42a | Cell Growth, Cell Division And DNA Synthesis; Cell Rescue, Defense, Cell Death And Aging; Cellular Organization; | YHR185C | | 42b | Unclassified Proteins; |
| YJL160C | | 43a | Cell Growth, Cell Division And DNA Synthesis; Cell Rescue, Defense, Cell Death And Aging; | YCR059C | | 43b | Unclassified Proteins; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YPL140C | MKK2 | 44a | Cell Growth, Cell Division And DNA Synthesis; Cellular Biogenesis; Signal Transduction; Cell Rescue, Defense, Cell Death And Aging; | YHR030C | SLT2 | 44b | Cell Growth, Cell Division And DNA Synthesis; Signal Transduction; Cell Rescue, Defense, Cell Death And Aging; |
| YLR288C | MEC3 | 45a | Cell Growth, Cell Division And DNA Synthesis; Cellular Biogenesis; Cell Rescue, Defense, Cell Death And Aging; | YMR159C | SAP18 | 45b | Unclassified Proteins; |
| YGR014W | MSB2 | 46a | Cell Growth, Cell Division And DNA Synthesis; Cellular Organization; | YJL030W | MAD2 | 46b | Cell Growth, Cell Division And DNA Synthesis; |
| YDL154W | MSH5 | 47a | Cell Growth, Cell Division And DNA Synthesis; Cellular Organization; | YBR133C | HSL7 | 47b | Cell Growth, Cell Division And DNA Synthesis; |
| YDL154W | MSH5 | 48a | Cell Growth, Cell Division And DNA Synthesis; Cellular Organization; | YMR224C | MRE11 | 48b | Cell Growth, Cell Division And DNA Synthesis; Cellular Biogenesis; Cell Rescue, Defense, Cell Death And Aging; Cellular Organization; |
| YAL040C | CLN3 | 49a | Cell Growth, Cell Division And DNA Synthesis; Cellular Organization; | YJL013C | MAD3 | 49b | Cell Growth, Cell Division And DNA Synthesis; Cellular Organization; |
| YPL049C | DIG1 | 50a | Cell Growth, Cell Division And DNA Synthesis; Cellular Organization; | YDR480W | DIG2 | 50b | Cell Growth, Cell Division And DNA Synthesis; Cellular Organization; |
| YER179W | DMC1 | 51a | Cell Growth, Cell Division And DNA Synthesis; Cellular Organization; | YER179W | DMC1 | 51b | Cell Growth, Cell Division And DNA Synthesis; Cellular Organization; |
| YIL150C | DNA43 | 52a | Cell Growth, Cell Division And DNA Synthesis; Cellular Organization; | YGL201C | MCM6 | 52b | Cell Growth, Cell Division And DNA Synthesis; Cellular Organization; |
| YGR014W | MSB2 | 53a | Cell Growth, Cell Division And DNA Synthesis; Cellular Organization; | YJL013C | MAD3 | 53b | Cell Growth, Cell Division And DNA Synthesis; Cellular Organization; |
| YHR184W | SSP1 | 54a | Cell Growth, Cell Division And DNA Synthesis; Cellular Organization; | YHR184W | SSP1 | 54b | Cell Growth, Cell Division And DNA Synthesis; Cellular Organization; |
| YDR388W | RVS167 | 55a | Cell Growth, Cell Division And DNA Synthesis; Cellular Organization; | YCR009C | RVS161 | 55b | Cell Growth, Cell Division And DNA Synthesis; Intracellular Transport; Cellular Organization; |
| YGR014W | MSB2 | 56a | Cell Growth, Cell Division And DNA Synthesis; Cellular Organization; | YDL165W | CDC36 | 56b | Cell Growth, Cell Division And DNA Synthesis; Transcription; Cellular Organization; |
| YDL154W | MSH5 | 57a | Cell Growth, Cell Division And DNA Synthesis; Cellular Organization; | YGL025C | PGD1 | 57b | Cell Growth, Cell Division And DNA Synthesis; Transcription; Cellular Organization; |
| YMR139W | RIM11 | 58a | Cell Growth, Cell Division And DNA Synthesis; Cellular Organization; | YJR094C | IME1 | 58b | Cell Growth, Cell Division And DNA Synthesis; Transcription; Cellular Organization; |
| YML031W | NDC1 | 59a | Cell Growth, Cell Division And DNA Synthesis; Cellular Organization; | YDL088C | ASM4 | 59b | Cell Rescue, Defense, Cell Death And Aging; |
| YDL017W | CDC7 | 60a | Cell Growth, Cell Division And DNA Synthesis; Cellular Organization; | YGR099W | TEL2 | 60b | Cellular Organization; |
| YGR014W | MSB2 | 61a | Cell Growth, Cell Division And DNA Synthesis; Cellular Organization; | YIL144W | TID3 | 61b | Cellular Organization; |
| YDL154W | MSH5 | 62a | Cell Growth, Cell Division And DNA Synthesis; Cellular Organization; | YIL144W | TID3 | 62b | Cellular Organization; |
| YDL017W | CDC7 | 63a | Cell Growth, Cell Division And DNA Synthesis; Cellular Organization; | YKL039W | PTM1 | 63b | Classification Not Yet Clear-Cut; |
| YOL069W | NUF2 | 64a | Cell Growth, Cell Division And DNA Synthesis; Cellular Organization; | YER099C | PRS2 | 64b | Metabolism; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YDR218C | SPR28 | 65a | Cell Growth, Cell Division And DNA Synthesis; Cellular Organization; | YJR076C | CDC11 | 65b | Metabolism; Cell Growth, Cell Division And DNA Synthesis; Cellular Organization; |
| YDL017W | CDC7 | 66a | Cell Growth, Cell Division And DNA Synthesis; Cellular Organization; | YJL088W | ARG3 | 66b | Metabolism; Cellular Organization; |
| YDL017W | CDC7 | 67a | Cell Growth, Cell Division And DNA Synthesis; Cellular Organization; | YDL160C | DHH1 | 67b | Transcription; Cellular Organization; |
| YGR014W | MSB2 | 68a | Cell Growth, Cell Division And DNA Synthesis; Cellular Organization; | YPL211W | NIP7 | 68b | Transcription; Cellular Organization; |
| YLR319C | BUD6 | 69a | Cell Growth, Cell Division And DNA Synthesis; Cellular Organization; | YGL015C | | 69b | Unclassified Proteins; |
| YDL017W | CDC7 | 70a | Cell Growth, Cell Division And DNA Synthesis; Cellular Organization; | YCR022C | | 70b | Unclassified Proteins; |
| YDL017W | CDC7 | 71a | Cell Growth, Cell Division And DNA Synthesis; Cellular Organization; | YCR050C | | 71b | Unclassified Proteins; |
| YDL017W | CDC7 | 72a | Cell Growth, Cell Division And DNA Synthesis; Cellular Organization; | YEL023C | | 72b | Unclassified Proteins; |
| YDL017W | CDC7 | 73a | Cell Growth, Cell Division And DNA Synthesis; Cellular Organization; | YFR057W | | 73b | Unclassified Proteins; |
| YDL017W | CDC7 | 74a | Cell Growth, Cell Division And DNA Synthesis; Cellular Organization; | YNR048W | | 74b | Unclassified Proteins; |
| YDL017W | CDC7 | 75a | Cell Growth, Cell Division And DNA Synthesis; Cellular Organization; | YOR006C | | 75b | Unclassified Proteins; |
| YDL154W | MSH5 | 76a | Cell Growth, Cell Division And DNA Synthesis; Cellular Organization; | YGL170C | | 76b | Unclassified Proteins; |
| YML031W | NDC1 | 77a | Cell Growth, Cell Division And DNA Synthesis; Cellular Organization; | YMR153W | | 77b | Unclassified Proteins; |
| YNL189W | SRP1 | 78a | Cell Growth, Cell Division And DNA Synthesis; Intracellular Transport; Cellular Organization; | YKL130C | SHE2 | 78b | Cell Growth, Cell Division And DNA Synthesis; Cellular Organization; |
| YDR335W | MSN5 | 79a | Cell Growth, Cell Division And DNA Synthesis; Intracellular Transport; | YDR146C | SWI5 | 79b | Cell Growth, Cell Division And DNA Synthesis; Transcription; Cellular Organization; |
| YNL189W | SRP1 | 80a | Cell Growth, Cell Division And DNA Synthesis; Intracellular Transport; Cellular Organization; | YML028W | TSA1 | 80b | Cell Rescue, Defense, Cell Death And Aging; Cellular Organization; |
| YNL189W | SRP1 | 81a | Cell Growth, Cell Division And DNA Synthesis; Intracellular Transport; Cellular Organization; | YMR226C | | 81b | Classification Not Yet Clear-Cut; |
| YNL154C | YCK2 | 82a | Cell Growth, Cell Division And DNA Synthesis; Intracellular Transport; Cell Rescue, Defense, Cell Death And Aging; Cellular Organization; | YOR355W | GDS1 | 82b | Classification Not Yet Clear-Cut; |
| YNL189W | SRP1 | 83a | Cell Growth, Cell Division And DNA Synthesis; Intracellular Transport; Cellular Organization; | YBR252W | DUT1 | 83b | Metabolism; |
| YNL189W | SRP1 | 84a | Cell Growth, Cell Division And DNA Synthesis; Intracellular Transport; Cellular Organization; | YPR062W | FCY1 | 84b | Metabolism; |
| YNL189W | SRP1 | 85a | Cell Growth, Cell Division And DNA Synthesis; Intracellular Transport; Cellular Organization; | YJR159W | SOR1 | 85b | Metabolism; |
| YNL189W | SRP1 | 86a | Cell Growth, Cell Division And DNA Synthesis; Intracellular Transport; Cellular Organization; | YPL214C | THI6 | 86b | Metabolism; |
| YNL189W | SRP1 | 87a | Cell Growth, Cell Division And DNA Synthesis; Intracellular Transport; Cellular Organization; | YFL061W | | 87b | Metabolism; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YNL189W | SRP1 | 88a | Cell Growth, Cell Division And DNA Synthesis; Intracellular Transport; Cellular Organization; | YOL058W | ARG1 | 88b | Metabolism; Cellular Organization; |
| YNL189W | SRP1 | 89a | Cell Growth, Cell Division And DNA Synthesis; Intracellular Transport; Cellular Organization; | YPL111W | CAR1 | 89b | Metabolism; Cellular Organization; |
| YNL189W | SRP1 | 90a | Cell Growth, Cell Division And DNA Synthesis; Intracellular Transport; Cellular Organization; | YLR303W | MET17 | 90b | Metabolism; Cellular Organization; |
| YNL189W | SRP1 | 91a | Cell Growth, Cell Division And DNA Synthesis; Intracellular Transport; Cellular Organization; | YDL236W | PHO13 | 91b | Metabolism; Cellular Organization; |
| YNL189W | SRP1 | 92a | Cell Growth, Cell Division And DNA Synthesis; Intracellular Transport; Cellular Organization; | YER065C | ICL1 | 92b | Metabolism; Energy; Cellular Organization; |
| YNL154C | YCK2 | 93a | Cell Growth, Cell Division And DNA Synthesis; Intracellular Transport; Cell Rescue, Defense, Cell Death And Aging; Cellular Organization; | YMR267W | PPA2 | 93b | Metabolism; Energy; Cellular Organization; |
| YNL189W | SRP1 | 94a | Cell Growth, Cell Division And DNA Synthesis; Intracellular Transport; Cellular Organization; | YGL221C | NIF3 | 94b | Transcription; |
| YNL189W | SRP1 | 95a | Cell Growth, Cell Division And DNA Synthesis; Intracellular Transport; Cellular Organization; | YHL009C | YAP3 | 95b | Transcription; Cellular Organization; |
| YNL154C | YCK2 | 96a | Cell Growth, Cell Division And DNA Synthesis; Intracellular Transport; Cell Rescue, Defense, Cell Death And Aging; Cellular Organization; | YCL054W | | 96b | Transcription; Cellular Organization; |
| YNL154C | YCK2 | 97a | Cell Growth, Cell Division And DNA Synthesis; Intracellular Transport; Cell Rescue, Defense, Cell Death And Aging; Cellular Organization; | YCR011C | ADP1 | 97b | Transport Facilitation; Cellular Organization; |
| YCR009C | RVS161 | 98a | Cell Growth, Cell Division And DNA Synthesis; Intracellular Transport; Cellular Organization; | YBR108W | | 98b | Unclassified Proteins; |
| YNL189W | SRP1 | 99a | Cell Growth, Cell Division And DNA Synthesis; Intracellular Transport; Cellular Organization; | YJR133W | YJR133W | 99b | Unclassified Proteins; |
| YNL189W | SRP1 | 100a | Cell Growth, Cell Division And DNA Synthesis; Intracellular Transport; Cellular Organization; | YGR024C | | 100b | Unclassified Proteins; |
| YNL154C | YCK2 | 101a | Cell Growth, Cell Division And DNA Synthesis; Intracellular Transport; Cell Rescue, Defense, Cell Death And Aging; Cellular Organization; | YER079W | | 101b | Unclassified Proteins; |
| YNL154C | YCK2 | 102a | Cell Growth, Cell Division And DNA Synthesis; Intracellular Transport; Cell Rescue, Defense, Cell Death And Aging; Cellular Organization; | YKL204W | | 102b | Unclassified Proteins; |
| YNL154C | YCK2 | 103a | Cell Growth, Cell Division And DNA Synthesis; Intracellular Transport; Cell Rescue, Defense, Cell Death And Aging; Cellular Organization; | YMR180C | | 103b | Unclassified Proteins; |
| YGL116W | CDC20 | 104a | Cell Growth, Cell Division And DNA Synthesis; Protein Destination; Cellular Organization; | YJL030W | MAD2 | 104b | Cell Growth, Cell Division And DNA Synthesis; |
| YJL001W | PRE3 | 105a | Cell Growth, Cell Division And DNA Synthesis; Protein Destination; Cell Rescue, Defense, Cell Death And Aging; Cellular Organization; | YLR386W | | 105b | Unclassified Proteins; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YFR052W | RPN12 | 106a | Cell Growth, Cell Division And DNA Synthesis; Protein Destination; Cell Rescue, Defense, Cell Death And Aging; Cellular Organization; | YDR273W | | 106b | Unclassified Proteins; |
| YFR052W | RPN12 | 107a | Cell Growth, Cell Division And DNA Synthesis; Protein Destination; Cell Rescue, Defense, Cell Death And Aging; Cellular Organization; | YJR133W | | 107b | Unclassified Proteins; |
| YBL105C | PKC1 | 108a | Cell Growth, Cell Division And DNA Synthesis; Signal Transduction; Cell Rescue, Defense, Cell Death And Aging; Cellular Organization; | YML109W | ZDS2 | 108b | Cell Growth, Cell Division And DNA Synthesis; |
| YPR054W | SMK1 | 109a | Cell Growth, Cell Division And DNA Synthesis; Signal Transduction; | YFL029C | CAK1 | 109b | Cell Growth, Cell Division And DNA Synthesis; |
| YLR229C | CDC42 | 110a | Cell Growth, Cell Division And DNA Synthesis; Signal Transduction; Cellular Organization; | YDL135C | RDI1 | 110b | Cell Growth, Cell Division And DNA Synthesis; Signal Transduction; Cellular Organization; |
| YLR362W | STE11 | 111a | Cell Growth, Cell Division And DNA Synthesis; Signal Transduction; | YCL032W | STE50 | 111b | Cell Growth, Cell Division And DNA Synthesis; Signal Transduction; |
| YJR086W | STE18 | 112a | Cell Growth, Cell Division And DNA Synthesis; Signal Transduction; Cellular Organization; | YOR212W | STE4 | 112b | Cell Growth, Cell Division And DNA Synthesis; Signal Transduction; Cellular Organization; |
| YLR305C | STT4 | 113a | Cell Growth, Cell Division And DNA Synthesis; Signal Transduction; | YOR355W | GDS1 | 113b | Classification Not Yet Clear-Cut; |
| YLR305C | STT4 | 114a | Cell Growth, Cell Division And DNA Synthesis; Signal Transduction; | YOR047C | STD1 | 114b | Metabolism; Transcription; |
| YMR052W | FAR3 | 115a | Cell Growth, Cell Division And DNA Synthesis; Signal Transduction; | YFR008W | | 115b | Unclassified Proteins; |
| YAR003W | | 116a | Cell Growth, Cell Division And DNA Synthesis; Transcription; | YBR175W | | 116b | Unclassified Proteins; |
| YAR003W | | 117a | Cell Growth, Cell Division And DNA Synthesis; Transcription; | YDR140W | | 117b | Unclassified Proteins; |
| YGL192W | IME4 | 118a | Cell Growth, Cell Division And DNA Synthesis; Transcription; Cellular Organization; | YBR057C | MUM2 | 118b | Cell Growth, Cell Division And DNA Synthesis; |
| YCL055W | KAR4 | 119a | Cell Growth, Cell Division And DNA Synthesis; Transcription; Cellular Organization; | YBR057C | MUM2 | 119b | Cell Growth, Cell Division And DNA Synthesis; |
| YNL210W | MER1 | 120a | Cell Growth, Cell Division And DNA Synthesis; Transcription; Cellular Organization; | YKL142W | MRP8 | 120b | Protein Synthesis; Cellular Organization; |
| YOR061W | CKA2 | 121a | Cell Growth, Cell Division And DNA Synthesis; Transcription; Cellular Organization; | YOR039W | CKB2 | 121b | Transcription; Cellular Organization; |
| YNR010W | CSE2 | 122a | Cell Growth, Cell Division And DNA Synthesis; Transcription; Cellular Organization; | YOR174W | MED4 | 122b | Transcription; Cellular Organization; |
| YHL027W | RIM101 | 123a | Cell Growth, Cell Division And DNA Synthesis; Transcription; Cellular Organization; | YJL056C | ZAP1 | 123b | Transcription; Cellular Organization; |
| YOL006C | TOP1 | 124a | Cell Growth, Cell Division And DNA Synthesis; Transcription; Cellular Organization; | YMR233W | | 124b | Unclassified Proteins; |
| YLR433C | CNA1 | 125a | Cell Growth, Cell Division And DNA Synthesis; Transcription; Ionic Homeostasis; Cellular Organization; | YNL047C | | 125b | Unclassified Proteins; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YGL058W | RAD6 | 126a | Cell Growth, Cell Division And DNA Synthesis; Transcription; Protein Destination; Cell Rescue, Defense, Cell Death And Aging; Cellular Organization; | YCR066W | RAD18 | 126b | Cell Growth, Cell Division And DNA Synthesis; Protein Destination; Cell Rescue, Defense, Cell Death And Aging; Cellular Organization; |
| YPR018W | RLF2 | 127a | Cell Growth, Cell Division And DNA Synthesis; Transcription; Protein Destination; Cellular Organization; | YBR195C | MSI1 | 127b | Cell Growth, Cell Division And DNA Synthesis; Transcription; Protein Destination; Cellular Biogenesis; Signal Transduction; |
| YHR084W | STE12 | 128a | Cell Growth, Cell Division And DNA Synthesis; Transcription; Signal Transduction; Cellular Organization; | YDR480W | DIG2 | 128b | Cell Growth, Cell Division And DNA Synthesis; Cellular Organization; |
| YBR244W | | 129a | Cell Rescue, Defense, Cell Death And Aging; | YLR117C | SYF3 | 129b | Cell Growth, Cell Division And DNA Synthesis; |
| YLL057C | | 130a | Cell Rescue, Defense, Cell Death And Aging; | YLL057C | | 130b | Cell Rescue, Defense, Cell Death And Aging; |
| YIL011W | | 131a | Cell Rescue, Defense, Cell Death And Aging; | YMR201C | RAD14 | 131b | Cell Rescue, Defense, Cell Death And Aging; Cellular Organization; |
| YHL046C | | 132a | Cell Rescue, Defense, Cell Death And Aging; | YOR355W | GDS1 | 132b | Classification Not Yet Clear-Cut; |
| YGR213C | RTA1 | 133a | Cell Rescue, Defense, Cell Death And Aging; | YHR134W | | 133b | Unclassified Proteins; |
| YDR061W | | 134a | Cell Rescue, Defense, Cell Death And Aging; | YCR086W | | 134b | Unclassified Proteins; |
| YLR046C | | 135a | Cell Rescue, Defense, Cell Death And Aging; | YHL006C | | 135b | Unclassified Proteins; |
| YJL092W | HPR5 | 136a | Cell Rescue, Defense, Cell Death And Aging; Cellular Organization; | YOR355W | GDS1 | 136b | Classification Not Yet Clear-Cut; |
| YDR077W | SED1 | 137a | Cell Rescue, Defense, Cell Death And Aging; Cellular Organization; | YDR044W | HEM13 | 137b | Metabolism; Cellular Organization; |
| YJL092W | HPR5 | 138a | Cell Rescue, Defense, Cell Death And Aging; Cellular Organization; | YDR510W | SMT3 | 138b | Protein Destination; |
| YJL092W | HPR5 | 139a | Cell Rescue, Defense, Cell Death And Aging; Cellular Organization; | YBR184W | MEL1 | 139b | Unclassified Proteins; |
| YJL092W | HPR5 | 140a | Cell Rescue, Defense, Cell Death And Aging; Cellular Organization; | YDR078C | PUN1 | 140b | Unclassified Proteins; |
| YLR390W | ECM19 | 141a | Cellular Biogenesis; | YDR145W | TAF61 | 141b | Transcription; |
| YHR171W | | 142a | Cellular Biogenesis; Cellular Organization; | YBR217W | | 142b | Protein Destination; Cellular Biogenesis; Cellular Organization; |
| YHR171W | | 143a | Cellular Biogenesis; Cellular Organization; | YNR007C | AUT1 | 143b | Protein Destination; Intracellular Transport; |
| YHR171W | | 144a | Cellular Biogenesis; Cellular Organization; | YBL078C | AUT1 | 144b | Protein Destination; Intracellular Transport; Cellular Organization; |
| YKR037C | | 145a | Cellular Organization; | YJR091C | JSN1 | 145b | Cell Growth, Cell Division And DNA Synthesis; |
| YCL059C | KRR1 | 146a | Cellular Organization; | YGL201C | MCM6 | 146b | Cell Growth, Cell Division And DNA Synthesis; Cellular Organization; |
| YDR106W | ARP10 | 147a | Cellular Organization; | YHR129C | ARP1 | 147b | Cell Growth, Cell Division And DNA Synthesis; Intracellular Transport; Cellular Organization; |
| YMR092C | AIP1 | 148a | Cellular Organization; | YLR102C | APC9 | 148b | Cell Growth, Cell Division And DNA Synthesis; Protein Destination; |
| YDR201W | | 149a | Cellular Organization; | YIL144W | TID3 | 149b | Cellular Organization; |
| YER018C | | 150a | Cellular Organization; | YMR117C | | 150b | Cellular Organization; |
| YKR037C | | 151a | Cellular Organization; | YDR201W | | 151b | Cellular Organization; |
| YLR429W | CRN1 | 152a | Cellular Organization; | YDR328C | SKP1 | 152b | Metabolism; Cell Growth, Cell Division And DNA Synthesis; Protein Destination; Cellular Organization; |
| YER018C | | 153a | Cellular Organization; | YHR193C | EGD2 | 153b | Metabolism; Transcription; Cellular Organization; |
| YDR122W | KIN1 | 154a | Cellular Organization; Classification Not Yet Clear-Cut; | YOL082W | | 154b | Unclassified Proteins; |
| YNL218W | | 155a | Classification Not Yet Clear-Cut; | YJL030W | MAD2 | 155b | Cell Growth, Cell Division And DNA Synthesis; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YNL023C | FAP1 | 156a | Classification Not Yet Clear-Cut; | YMR224C | MRE11 | 156b | Cell Growth, Cell Division And DNA Synthesis; Cellular Biogenesis; Cell Rescue, Defense, Cell Death And Aging; Cellular Organization; |
| YNL023C | FAP1 | 157a | Classification Not Yet Clear-Cut; | YKL130C | SHE2 | 157b | Cell Growth, Cell Division And DNA Synthesis; Cellular Organization; |
| YCL024W | | 158a | Classification Not Yet Clear-Cut; | YKR048C | NAP1 | 158b | Cell Growth, Cell Division And DNA Synthesis; Protein Destination; Cellular Biogenesis; Cellular Organization; |
| YFR024C-A | | 159a | Classification Not Yet Clear-Cut; | YBL007C | SLA1 | 159b | Cell Growth, Cell Division And DNA Synthesis; Protein Destination; Cellular Organization; |
| YNL218W | | 160a | Classification Not Yet Clear-Cut; | YNL218W | | 160b | Classification Not Yet Clear-Cut; |
| YLL046C | RNP1 | 161a | Classification Not Yet Clear-Cut; | YFR047C | | 161b | Metabolism; |
| YBR274W | | 162a | Classification Not Yet Clear-Cut; | YLR258W | GSY2 | 162b | Metabolism; Energy; Cellular Organization; |
| YDL002C | NHP10 | 163a | Classification Not Yet Clear-Cut; | YER092W | | 163b | Unclassified Proteins; |
| YER059W | PCL6 | 164a | Classification Not Yet Clear-Cut; | YJL084C | | 164b | Unclassified Proteins; |
| YER059W | PCL6 | 165a | Classification Not Yet Clear-Cut; | YLR190W | | 165b | Unclassified Proteins; |
| YBR274W | | 166a | Classification Not Yet Clear-Cut; | YMR255W | | 166b | Unclassified Proteins; |
| YDR084C | | 167a | Classification Not Yet Clear-Cut; | YGL161C | | 167b | Unclassified Proteins; |
| YDR084C | | 168a | Classification Not Yet Clear-Cut; | YGL198W | | 168b | Unclassified Proteins; |
| YFR024C-A | | 169a | Classification Not Yet Clear-Cut; | YGR268C | | 169b | Unclassified Proteins; |
| YMR077C | | 170a | Classification Not Yet Clear-Cut; | YKL052C | | 170b | Unclassified Proteins; |
| YHR039C | | 171a | Energy; | YDR480W | DIG2 | 171b | Cell Growth, Cell Division And DNA Synthesis; Cellular Organization; |
| YPR048W | | 172a | Energy; | YOR355W | GDS1 | 172b | Classification Not Yet Clear-Cut; |
| YPR048W | | 173a | Energy; | YDL215C | GDH2 | 173b | Metabolism; Cellular Organization; |
| YPR048W | | 174a | Energy; | YNL199C | GCR2 | 174b | Metabolism; Transcription; Cellular Organization; |
| YNL118C | PSU1 | 175a | Energy; | YOL149W | DCP1 | 175b | Transcription; |
| YNL118C | PSU1 | 176a | Energy; | YEL015W | | 176b | Unclassified Proteins; |
| YPR048W | | 177a | Energy; | YPR070W | | 177b | Unclassified Proteins; |
| YPL174C | NIP100 | 178a | Intracellular Transport; | YHR129C | ARP1 | 178b | Cell Growth, Cell Division And DNA Synthesis; Intracellular Transport; Cellular Organization; |
| YPL174C | NIP100 | 179a | Intracellular Transport; | YIL144W | TID3 | 179b | Cellular Organization; |
| YGR057C | LST7 | 180a | Intracellular Transport; | YKL015W | PUT3 | 180b | Metabolism; Transcription; Cellular Organization; |
| YPL174C | NIP100 | 181a | Intracellular Transport; | YJL184W | | 181b | Unclassified Proteins; |
| YER105C | NUP157 | 182a | Intracellular Transport; Cellular Organization; | YJL030W | MAD2 | 182b | Cell Growth, Cell Division And DNA Synthesis; |
| YFR002W | NIC96 | 183a | Intracellular Transport; Cellular Organization; | YGR120C | | 183b | Intracellular Transport; Cellular Organization; |
| YHL019C | APM2 | 184a | Intracellular Transport; Cellular Organization; | YKL135C | APL2 | 184b | Protein Destination; Intracellular Transport; Cellular Organization; |
| YGR119C | NUP57 | 185a | Intracellular Transport; Cellular Organization; | YMR236W | TAF17 | 185b | Transcription; Cellular Organization; |
| YGR119C | NUP57 | 186a | Intracellular Transport; Cellular Organization; | YJL041W | NSP1 | 186b | Transcription; Intracellular Transport; Cellular Organization; |
| YGR119C | NUP57 | 187a | Intracellular Transport; Cellular Organization; | YGL172W | NUP49 | 187b | Transcription; Intracellular Transport; Cellular Organization; |
| YFR002W | NIC96 | 188a | Intracellular Transport; Cellular Organization; | YMR153W | | 188b | Unclassified Proteins; |
| YER105C | NUP157 | 189a | Intracellular Transport; Cellular Organization; | YEL015W | | 189b | Unclassified Proteins; |
| YER105C | NUP157 | 190a | Intracellular Transport; Cellular Organization; | YMR153W | | 190b | Unclassified Proteins; |
| YMR129W | POM152 | 191a | Intracellular Transport; Cellular Organization; | YJL057C | IKS1 | 191b | Unclassified Proteins; |
| YMR129W | POM152 | 192a | Intracellular Transport; Cellular Organization; | YMR153W | | 192b | Unclassified Proteins; |
| YNL287W | SEC21 | 193a | Intracellular Transport; Cellular Organization; | YBR281C | | 193b | Unclassified Proteins; |
| YOR115C | | 194a | Intracellular Transport; Cellular Organization; | YOL082W | | 194b | Unclassified Proteins; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YDR503C | LPP1 | 195a | Metabolism; | YKL130C | SHE2 | 195b | Cell Growth, Cell Division And DNA Synthesis; Cellular Organization; |
| YOR128C | ADE2 | 196a | Metabolism; | YCR066W | RAD18 | 196b | Cell Growth, Cell Division And DNA Synthesis; Protein Destination; Cell Rescue, Defense, Cell Death And Aging; Cellular Organization; |
| YNL201C | | 197a | Metabolism; | YOR355W | GDS1 | 197b | Classification Not Yet Clear-Cut; |
| YOR128C | ADE2 | 198a | Metabolism; | YCR067C | SED4 | 198b | Intracellular Transport; Cellular Organization; |
| YOR128C | ADE2 | 199a | Metabolism; | YOR128C | ADE2 | 199b | Metabolism; |
| YIR032C | DAL3 | 200a | Metabolism; | YIR032C | DAL3 | 200b | Metabolism; |
| YGR267C | FOL2 | 201a | Metabolism; | YGR267C | FOL2 | 201b | Metabolism; |
| YOL061W | PRS5 | 202a | Metabolism; | YER099C | PRS2 | 202b | Metabolism; |
| YPL214C | THI6 | 203a | Metabolism; | YPL214C | THI6 | 203b | Metabolism; |
| YNR012W | URK1 | 204a | Metabolism; | YDR020C | | 204b | Metabolism; |
| YDL246C | | 205a | Metabolism; | YJR159W | SOR1 | 205b | Metabolism; |
| YDL246C | | 206a | Metabolism; | YDL246C | | 206b | Metabolism; |
| YFR047C | | 207a | Metabolism; | YFR047C | | 207b | Metabolism; |
| YHL018W | | 208a | Metabolism; | YHL018W | | 208b | Metabolism; |
| YHR111W | | 209a | Metabolism; | YHR111W | | 209b | Metabolism; |
| YIL074C | | 210a | Metabolism; | YER081W | | 210b | Metabolism; |
| YIL074C | | 211a | Metabolism; | YIL074C | | 211b | Metabolism; |
| YLR245C | | 212a | Metabolism; | YLR245C | | 212b | Metabolism; |
| YLR432W | | 213a | Metabolism; | YDL215C | GDH2 | 213b | Metabolism; Cellular Organization; |
| YNL201C | | 214a | Metabolism; | YFL056C | AAD6 | 214b | Metabolism; Energy; |
| YOR226C | | 215a | Metabolism; | YPL088W | | 215b | Metabolism; Energy; |
| YNL201C | | 216a | Metabolism; | YOR047C | STD1 | 216b | Metabolism; Transcription; |
| YDL013W | HEX3 | 217a | Metabolism; | YDR510W | SMT3 | 217b | Protein Destination; |
| YLR432W | | 218a | Metabolism; | YKR026C | GCN3 | 218b | Protein Synthesis; Cellular Organization; |
| YHR204W | | 219a | Metabolism; | YGL030W | RPL30 | 219b | Protein Synthesis; Cellular Organization; |
| YBR006W | | 220a | Metabolism; | YDR382W | RPP2B | 220b | Protein Synthesis; Cellular Organization; |
| YDL013W | HEX3 | 221a | Metabolism; | YER116C | | 221b | Transcription; |
| YNL201C | | 222a | Metabolism; | YPR115W | | 222b | Transcription; |
| YPL059W | | 223a | Metabolism; | YIL105C | | 223b | Transcription; |
| YLR432W | | 224a | Metabolism; | YDR167W | TAF25 | 224b | Transcription; Cellular Organization; |
| YOR128C | ADE2 | 225a | Metabolism; | YBR134W | | 225b | Unclassified Proteins; |
| YGR155W | CYS4 | 226a | Metabolism; | YCR086W | | 226b | Unclassified Proteins; |
| YOR269W | PAC1 | 227a | Metabolism; | YLR254C | | 227b | Unclassified Proteins; |
| YBR006W | | 228a | Metabolism; | YKL023W | | 228b | Unclassified Proteins; |
| YDL203C | | 229a | Metabolism; | YGR058W | | 229b | Unclassified Proteins; |
| YDL203C | | 230a | Metabolism; | YOR372C | | 230b | Unclassified Proteins; |
| YDR400W | | 231a | Metabolism; | YCR059C | | 231b | Unclassified Proteins; |
| YHR204W | | 232a | Metabolism; | YER126C | | 232b | Unclassified Proteins; |
| YLR432W | | 233a | Metabolism; | YDR469W | | 233b | Unclassified Proteins; |
| YPL059W | | 234a | Metabolism; | YNL047C | | 234b | Unclassified Proteins; |
| YDL006W | PTC1 | 235a | Metabolism Cell Growth, Cell Division And DNA Synthesis; Cellular Biogenesis; Signal Transduction; Cell Rescue, Defense, Cell Death And Aging; | YDR162C | NBP2 | 235b | Protein Destination; |
| YDR328C | SKP1 | 236a | Metabolism; Cell Growth, Cell Division And DNA Synthesis; Protein Destination; Cellular Organization; | YFL009W | CDC4 | 236b | Cell Growth, Cell Division And DNA Synthesis; Cellular Organization; |
| YGL155W | CDC43 | 237a | Metabolism; Cell Growth, Cell Division And DNA Synthesis; Protein Destination; Cellular Organization; | YKL019W | RAM2 | 237b | Metabolism; Protein Destination; Cellular Organization; |
| YDR328C | SKP1 | 238a | Metabolism; Cell Growth, Cell Division And DNA Synthesis; Protein Destination; Cellular Organization; | YLR352W | | 238b | Unclassified Proteins; |
| YPL161C | BEM4 | 239b | Metabolism; Cell Growth, Cell Division And DNA Synthesis; Signal Transduction; | YGL126W | SCS3 | 239b | Metabolism; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YPL161C | BEM4 | 240a | Metabolism; Cell Growth, Cell Division And DNA Synthesis; Signal Transduction; | YIL163C | | 240b | Unclassified Proteins; |
| YPL161C | BEM4 | 241a | Metabolism; Cell Growth, Cell Division And DNA Synthesis; Signal Transduction; | YLR049C | | 241b | Unclassified Proteins; |
| YNL236W | SIN4 | 242a | Metabolism; Cell Growth, Cell Division And DNA Synthesis; Transcription; Cellular Organization; | YJL030W | MAD2 | 242b | Cell Growth, Cell Division And DNA Synthesis; |
| YNL236W | SIN4 | 243a | Metabolism; Cell Growth, Cell Division And DNA Synthesis; Transcription; Cellular Organization; | YGL238W | CSE1 | 243b | Cell Growth, Cell Division And DNA Synthesis; Cellular Organization; |
| YNL236W | SIN4 | 244a | Metabolism; Cell Growth, Cell Division And DNA Synthesis; Transcription; Cellular Organization; | YJL013C | MAD3 | 244b | Cell Growth, Cell Division And DNA Synthesis; Cellular Organization; |
| YNL236W | SIN4 | 245a | Metabolism; Cell Growth, Cell Division And DNA Synthesis; Transcription; Cellular Organization; | YOR355W | GDS1 | 245b | Classification Not Yet Clear-Cut; |
| YDR207C | UME6 | 246a | Metabolism; Cell Growth, Cell Division And DNA Synthesis; Transcription; Cellular Organization; | YOR355W | GDS1 | 246b | Classification Not Yet Clear-Cut; |
| YNL236W | SIN4 | 247a | Metabolism; Cell Growth, Cell Division And DNA Synthesis; Transcription; Cellular Organization; | YFR033C | QCR6 | 247b | Energy; Cellular Organization; |
| YNL236W | SIN4 | 248a | Metabolism; Cell Growth, Cell Division And DNA Synthesis; Transcription; Cellular Organization; | YJR034W | PET191 | 248b | Energy; Protein Destination; Cellular Organization; |
| YNL236W | SIN4 | 249a | Metabolism; Cell Growth, Cell Division And DNA Synthesis; Transcription; Cellular Organization; | YDR054C | CDC34 | 249b | Metabolism; Cell Growth, Cell Division And DNA Synthesis; Protein Destination; Cellular Organization; |
| YNL236W | SIN4 | 250a | Metabolism; Cell Growth, Cell Division And DNA Synthesis; Transcription; Cellular Organization; | YKL012W | PRP40 | 250b | Transcription; Cellular Organization; |
| YNL236W | SIN4 | 251a | Metabolism; Cell Growth, Cell Division And DNA Synthesis; Transcription; Cellular Organization; | YGR046W | | 251b | Unclassified Proteins; |
| YNL236W | SIN4 | 252a | Metabolism; Cell Growth, Cell Division And DNA Synthesis; Transcription; Cellular Organization; | YGR117C | | 252b | Unclassified Proteins; |
| YDR207C | UME6 | 253a | Metabolism; Cell Growth, Cell Division And DNA Synthesis; Transcription; Cellular Organization; | YOL082W | | 253b | Unclassified Proteins; |
| YGR144W | THI43 | 254a | Metabolism; Cell Rescue, Defense, Cell Death And Aging; | YGR144W | THI4 | 254b | Metabolism; Cell Rescue, Defense, Cell Death And Aging; |
| YER062C | HOR2 | 255a | Metabolism; Cell Rescue, Defense, Cell Death And Aging; | YPL201C | | 255b | Unclassified Proteins; |
| YDR477W | SNF1 | 256a | Metabolism; Cell Rescue, Defense, Cell Death And Aging; Cellular Organization; | YER027C | GAL83 | 256b | Metabolism; Transcription; |
| YBR176W | ECM31 | 257a | Metabolism; Cellular Biogenesis; | YBR176W | ECM31 | 257b | Metabolism; Cellular Biogenesis; |
| YDR376W | ARH1 | 258a | Metabolism; Cellular Organization; | YIR024C | GIF1 | 258b | Cell Growth, Cell Division And DNA Synthesis; |
| YDR408C | ADE8 | | Metabolism; Cellular Organization; | YGL127C | SOH1 | | Cell Growth, Cell Division And DNA Synthesis; Transcription; |
| YDR376W | ARH1 | 259a | Metabolism; Cellular Organization; | YCR093W | CDC39 | 259b | Cell Growth, Cell Division And DNA Synthesis; Transcription; Cellular Organization; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YDR408C | ADE8 | 260a | Metabolism; Cellular Organization; | YCR063W | | 260b | Classification Not Yet Clear-Cut; |
| YLR438W | CAR2 | 261a | Metabolism; Cellular Organization; | YHL025W | SNF6 | 261b | Metabolism; Cell Growth, Cell Division And DNA Synthesis; Transcription; Cellular Organization; |
| YOR180C | EHD2 | 262a | Metabolism; Cellular Organization; | YLR284C | EHD1 | 262b | Metabolism; Cellular Organization; |
| YOR202W | HIS3 | 263a | Metabolism; Cellular Organization; | YOR202W | HIS3 | 263b | Metabolism; Cellular Organization; |
| YER023W | PRO3 | 264a | Metabolism; Cellular Organization; | YER023W | PRO3 | 264b | Metabolism; Cellular Organization; |
| YKL067W | YNK1 | 265a | Metabolism; Cellular Organization; | YKL067W | YNK1 | 265b | Metabolism; Cellular Organization; |
| YGL154C | LYS5 | 266a | Metabolism; Cellular Organization; | YGL154W | FZF1 | 266b | Metabolism; Transcription; Cell Rescue, Defense, Cell Death And Aging; Cellular Organization; |
| YGR229C | SMI1 | 267a | Metabolism; Cellular Organization; | YKR099W | BAS1 | 267b | Metabolism; Transcription; Cellular Organization; |
| YBL042C | FUI1 | 268a | Metabolism; Cellular Organization; | YER021W | RPN3 | 268b | Protein Destination; |
| YHR128W | FUR1 | 269a | Metabolism; Cellular Organization; | YPR185W | APG13 | 269b | Protein Destination; Intracellular Transport; |
| YOR375C | GDH1 | 270a | Metabolism; Cellular Organization; | YJL124C | SPB8 | 270b | Transcription; |
| YDR408C | ADE8 | 271a | Metabolism; Cellular Organization; | YOR174W | MED4 | 271b | Transcription; Cellular Organization; |
| YOR303W | CPA1 | 272a | Metabolism; Cellular Organization; | YOR039W | CKB2 | 272b | Transcription; Cellular Organization; |
| YGR061C | ADE6 | 273a | Metabolism; Cellular Organization; | YLR386W | | 273b | Unclassified Proteins; |
| YLR438W | CAR2 | 274a | Metabolism; Cellular Organization; | YGR010W | | 274b | Unclassified Proteins; |
| YLR438W | CAR2 | 275a | Metabolism; Cellular Organization; | YLR328W | | 275b | Unclassified Proteins; |
| YOL059W | GPD2 | 276a | Metabolism; Cellular Organization; | YFL017C | | 276b | Unclassified Proteins; |
| YNL104C | LEU4 | 277a | Metabolism; Cellular Organization; | YKL183W | | 277b | Unclassified Proteins; |
| YLR345W | | 278a | Metabolism; Energy; | YLR321C | SFH1 | 278b | Cell Growth, Cell Division And DNA Synthesis; Transcription; Cellular Biogenesis; Cellular Organization; |
| YJL137C | GLG2 | 279a | Metabolism; Energy; | YJL137C | GLG2 | 279b | Metabolism; Energy; |
| YGL134W | PCL10 | 280a | Metabolism; Energy; | YPL031C | PHO85 | 280b | Metabolism; Energy; Cell Growth, Cell Division And DNA Synthesis; Transcription; Cellular Organization; |
| YLR345W | | 281a | Metabolism; Energy; | YGR158C | MTR3 | 281b | Transcription; Cellular Organization; |
| YKR096W | | 282a | Metabolism; Energy; | YBL051C | | 282b | Unclassified Proteins; |
| YER133W | GLC7 | 283a | Metabolism; Energy; Cell Growth, Cell Division And DNA Synthesis; Protein Synthesis; Cellular Organization; | YNL233W | BNI4 | 283b | Cell Growth, Cell Division And DNA Synthesis; Protein Destination; Cellular Organization; |
| YLR071C | RGR1 | 284a | Metabolism; Energy; Cell Growth, Cell Division And DNA Synthesis; Transcription; Cellular Organization; | YDL065C | PEX19 | 284b | Cellular Organization; |
| YDR074W | TPS2 | 285a | Metabolism; Energy; Cell Rescue, Defense, Cell Death And Aging; Cellular Organization; | YER019C-A | SBH2 | 285b | Protein Destination; Transport Facilitation; Intracellular Transport; |
| YDR074W | TPS2 | 286a | Metabolism; Energy; Cell Rescue, Defense, Cell Death And Aging; Cellular Organization; | YAR066W | | 286b | Unclassified Proteins; |
| YBR221C | PDB1 | 287a | Metabolism; Energy; Cellular Organization; | YLR345W | | 287b | Metabolism; Energy; |
| YDR148C | KGD2 | 288a | Metabolism; Energy; Cellular Organization; | YDR510W | SMT3 | 288b | Protein Destination; |
| YMR267W | PPA2 | 289a | Metabolism; Energy; Cellular Organization; | YKR026C | GCN3 | 289b | Protein Synthesis; Cellular Organization; |
| YDR001C | | 290a | Metabolism; Energy; Cellular Organization; | YLR270W | | 290b | Unclassified Proteins; |
| YCL040W | GLK1 | 291a | Metabolism; Energy; Intracellular Transport; Cellular Organization; | YBR040W | FIG1 | 291b | Cell Growth, Cell Division And DNA Synthesis; Cellular Organization; |
| YCL040W | GLK1 | 292a | Metabolism; Energy; Intracellular Transport; Cellular Organization; | YML099C | ARG81 | 292b | Metabolism; Transcription; Cellular Organization; |
| YMR079W | SEC14 | 293a | Metabolism; Intracellular Transport; Cellular Organization; | YDL001W | | 293b | Unclassified Proteins; |
| YDL090C | RAM1 | 294a | Metabolism; Protein Destination; Signal Transduction; Cellular Organization; | YKL019W | RAM2 | 294b | Metabolism; Protein Destination; Cellular Organization; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YLR150W | STM1 | 295a | Metabolism; Signal Transduction; | YJR072C | | 295b | Unclassified Proteins; |
| YGL254W | FZF1 | 296a | Metabolism; Transcription; Cell Rescue, Defense, Cell Death And Aging; Cellular Organization; | YHR215W | PHO12 | 296b | Metabolism; Cellular Organization; |
| YGL115W | SNF4 | 297a | Metabolism; Transcription; Cell Rescue, Defense, Cell Death And Aging; Cellular Organization; | YER027C | GAL83 | 297b | Metabolism; Transcription; |
| YGL254W | FZF1 | 298a | Metabolism; Transcription; Cell Rescue, Defense, Cell Death And Aging; Cellular Organization; | YOR039W | CKB2 | 298b | Transcription; Cellular Organization; |
| YGL254W | FZF1 | 299a | Metabolism; Transcription; Cell Rescue, Defense, Cell Death And Aging; Cellular Organization; | YGR047C | TFC4 | 299b | Transcription; Cellular Organization; |
| YOL108C | INO4 | 300a | Metabolism; Transcription; Cellular Organization; | YKL017C | HCS1 | 300b | Cell Growth, Cell Division And DNA Synthesis; |
| YOL108C | INO4 | 301a | Metabolism; Transcription; Cellular Organization; | YMR317W | | 301b | Cellular Biogenesis; |
| YNL314W | DAL82 | 302a | Metabolism; Transcription; Cellular Organization; | YNL314W | DAL82 | 302b | Metabolism; Transcription; Cellular Organization; |
| YOL108C | INO4 | 303a | Metabolism; Transcription; Cellular Organization; | YDR123C | INO2 | 303b | Metabolism; Transcription; Cellular Organization; |
| YOL108C | INO4 | 304a | Metabolism; Transcription; Cellular Organization; | YKL135C | APL2 | 304b | Protein Destination; Intracellular Transport; Cellular Organization; |
| YJL110C | GZF3 | 305a | Metabolism; Transcription; Cellular Organization; | YNL021W | HDA1 | 305b | Transcription; Protein Destination; Cellular Organization; |
| YOL108C | INO4 | 306a | Metabolism; Transcription; Cellular Organization; | YNL279W | | 306b | Unclassified Proteins; |
| YOR348C | PUT4 | 307a | Metabolism; Transport Facilitation; Intracellular Transport; Cellular Organization; | YMR228W | MTF1 | 307b | Cell Growth, Cell Division And DNA Synthesis; Transcription; Cellular Organization; |
| YOR348C | PUT4 | 308a | Metabolism; Transport Facilitation; Intracellular Transport; Cellular Organization; | YCR045C | | 308b | Protein Destination; |
| YOR348C | PUT4 | 309a | Metabolism; Transport Facilitation; Intracellular Transport; Cellular Organization; | YJL084C | | 309b | Unclassified Proteins; |
| YOR348C | PUT4 | 310a | Metabolism; Transport Facilitation; Intracellular Transport; Cellular Organization; | YLR294C | | 310b | Unclassified Proteins; |
| YMR091C | NPL6 | 311a | Protein Destination; | YFR037C | RSC8 | 311b | Cell Growth, Cell Division And DNA Synthesis; Transcription; Cellular Organization; |
| YER144C | UBP5 | 312a | Protein Destination; | YBR059C | | 312b | Classification Not Yet Clear-Cut; |
| YLR417W | VPS36 | 313a | Protein Destination; | YPL002C | SNF8 | 313b | Metabolism; |
| YDL097C | RPN6 | 314a | Protein Destination; | YEL009C | GCN4 | 314b | Metabolism; Transcription; Cellular Organization; |
| YDR394W | RPT3 | 315a | Protein Destination; | YGR232W | | 315b | Protein Destination; |
| YPL003W | ULA1 | 316a | Protein Destination; | YPR066W | UBA3 | 316b | Protein Destination; |
| YOR132W | VPS17 | 317a | Protein Destination; | YOR069W | VPS5 | 317b | Protein Destination; Cellular Organization; |
| YDR098C | | 318a | Protein Destination; | YGL071W | RCS1 | 318b | Transcription; Ionic Homeostasis; Cellular Organization; |
| YER174C | | 319a | Protein Destination; | YGL071W | RCS1 | 319b | Transcription; Ionic Homeostasis; Cellular Organization; |
| YML094W | GIM5 | 320a | Protein Destination; | YLR200W | YKE2 | 320b | Unclassified Proteins; |
| YOL111C | | 321a | Protein Destination; | YOR007C | SGT2 | 321b | Unclassified Proteins; |
| YHR057C | CYP2 | 322a | Protein Destination; Cell Rescue, Defense, Cell Death And Aging; Cellular Organization; | YJR091C | JSN1 | 322b | Cell Growth, Cell Division And DNA Synthesis; |
| YPL149W | APG5 | 323a | Protein Destination; Cellular Biogenesis; Cellular Organization; | YBR217W | | 323b | Protein Destination; Cellular Biogenesis; Cellular Organization; |
| YPL149W | APG5 | 324a | Protein Destination; Cellular Biogenesis; Cellular Organization; | YMR159C | SAP18 | 324b | Unclassified Proteins; |
| YBR217W | | 325a | Protein Destination; Cellular Biogenesis; Cellular Organization; | YMR159C | SAP18 | 325b | Unclassified Proteins; |
| YMR314W | PRE5 | 326a | Protein Destination; Cellular Organization; | YKL130C | SHE2 | 326b | Cell Growth, Cell Division And DNA Synthesis; Cellular Organization; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YPR051W | MAK3 | 327a | Protein Destination; Cellular Organization; | YEL053C | MAK10 | 327b | Energy; |
| YNL135C | FPR1 | 328a | Protein Destination; Cellular Organization; | YER052C | HOM3 | 328b | Metabolism; |
| YKL103C | LAP4 | 329a | Protein Destination; Cellular Organization; | YKL103C | LAP4 | 329b | Protein Destination; Cellular Organization; |
| YHR060W | VMA22 | 330a | Protein Destination; Cellular Organization; | YLR447C | VMA6 | 330b | Protein Destination; Transport Facilitation; Intracellular Transport; Ionic Homeostatis; Cellular Organization; |
| YOL088C | MPD2 | 331a | Protein Destination; Cellular Organization; | YHR091C | MSR1 | 331a | Protein Synthesis; Cellular Organization; |
| YKL103C | LAP4 | 332a | Protein Destination; Cellular Organization; | YOL082W | | 332b | Unclassified Proteins; |
| YOL088C | MPD2 | 333a | Protein Destination; Cellular Organization; | YLR312C | | 333b | Unclassified Proteins; |
| YEL060C | PRB1 | 334a | Protein Destination; Cellular Organization; | YML032C-A | | 334b | Unclassified Proteins; |
| YOR362C | PRE10 | 335a | Protein Destination; Cellular Organization; | YFL017C | | 335b | Unclassified Proteins; |
| YDR292C | SRP101 | 336a | Protein Destination; Cellular Organization; | YMR163C | | 336b | Unclassified Proteins; |
| YHR060W | VMA22 | 337a | Protein Destination; Cellular Organization; | YDR469W | | 337b | Unclassified Proteins; |
| YPR185W | APG13 | 338a | Protein Destination; Intracellular Transport; | YGL180W | APG1 | 338b | Cell Growth, Cell Division And DNA Synthesis; Protein Destination; Intracellular Transport; Cellular Organization; |
| YPR185W | APG13 | 339a | Protein Destination; Intracellular Transport; | YGR253C | PUP2 | 339b | Cell Growth, Cell Division And DNA Synthesis; Protein Destination; Cell Rescue, Defense, Cell Death And Aging; Cellular Organization; |
| YPR185W | APG13 | 340a | Protein Destination; Intracellular Transport; | YGR120C | | 340b | Intracellular Transport; Cellular Organization; |
| YBR170C | NPL4 | 341a | Protein Destination; Intracellular Transport; | YGR048W | UFD1 | 341b | Protein Destination; |
| YPR185W | APG13 | 342a | Protein Destination; Intracellular Transport; | YNL086W | | 342b | Unclassified Proteins; |
| YNL093W | YPT53 | 343a | Protein Destination; Intracellular Transport; | YNL032W | SIW14 | 343b | Unclassified Proteins; |
| YPR173C | VPS4 | 344a | Protein Destination; Intracellular Transport; Cellular Biogenesis; Cellular Organization; | YLR025W | SNF7 | 344b | Metabolism; Cell Growth, Cell Division And DNA Synthesis; Protein Destination; Cellular Organization; |
| YPL259C | APM1 | 345a | Protein Destination; Intracellular Transport; Cellular Biogenesis; Cellular Organization; | YKL135C | APL2 | 345b | Protein Destination; Intracellular Transport; Cellular Organization; |
| YJL154C | VPS35 | 346a | Protein Destination; Intracellular Transport; Cellular Biogenesis; Cellular Organization; | YGL166W | CUP2 | 346b | Transcription; Ionic Homeostasis; Cellular Organization; |
| YDR142C | PEX7 | 347a | Protein Destination; Intracellular Transport; Cellular Organization; | YIL160C | POT1 | 347b | Metabolism; Energy; Cellular Organization; |
| YNR006W | VPS27 | 348a | Protein Destination; Intracellular Transport; Cellular Organization; | YHL002W | | 348b | Signal Transduction; |
| YDR142C | PEX7 | 349a | Protein Destination; Intracellular Transport; Cellular Organization; | YGR239C | | 349b | Unclassified Proteins; |
| YDR142C | PEX7 | 350a | Protein Destination; Intracellular Transport; Cellular Organization; | YHR160C | | 350b | Unclassified Proteins; |
| YDL212W | SHR3 | 351a | Protein Destination; Signal Transduction; Cellular Organization; | YDR508C | GNP1 | 351b | Metabolism; Transport Organization; |
| YDR115W | | 352a | Protein Synthesis; | YKL142W | MRP8 | 352b | Protein Synthesis; Cellular Organization; |
| YER102W | RPS8B | 353a | Protein Synthesis; Cellular Organization; | YBR135W | CKS1 | 353b | Cell Growth, Cell Division And DNA Synthesis; |
| YOR276W | CAF20 | 354a | Protein Synthesis; Cellular Organization; | YOL139C | CDC33 | 354b | Cell Growth, Cell Division And DNA Synthesis; Protein Synthesis; Cellular Organization; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YKL142W | MRP8 | 355a | Protein Synthesis; Cellular Organization; | YMR165C | SMP2 | 355b | Energy; Cell Growth, Cell Division And DNA Synthesis; Cellular Biogenesis; |
| YKR026C | GCN3 | 356a | Protein Synthesis; Cellular Organization; | YKR026C | GCN3 | 356b | Protein Synthesis; Cellular Organization; |
| YKL142W | MRP8 | 357a | Protein Synthesis; Cellular Organization; | YKL142W | MRP8 | 357b | Protein Synthesis; Cellular Organization; |
| YMR309C | NIP1 | 358a | Protein Synthesis; Cellular Organization; | YNL244C | SUI1 | 358b | Protein Synthesis; Cellular Organization; |
| YLR264W | RPS28B | 359a | Protein Synthesis; Cellular Organization; | YOL149W | DCP1 | 359b | Transcription; |
| YLR291C | GCD7 | 360a | Protein Synthesis; Cellular Organization; | YPL070W | | 360b | Unclassified Proteins; |
| YMR309C | NIP1 | 361a | Protein Synthesis; Cellular Organization; | YNL047C | | 361b | Unclassified Proteins; |
| YMR309C | NIP1 | 362a | Protein Synthesis; Cellular Organization, | YOR284W | | 362b | Unclassified Proteins; |
| YGL189C | RPS26A | 363a | Protein Synthesis; Cellular Organization; | YLR435W | | 363b | Unclassified Proteins; |
| YER131W | RPS26B | 364a | Protein Synthesis; Cellular Organization; | YLR435W | | 364b | Unclassified Proteins; |
| YLR264W | RPS28B | 365a | Protein Synthesis; Cellular Organization; | YBR094W | | 365b | Unclassified Proteins; |
| YER102W | RPS8B | 366a | Protein Synthesis; Cellular Organization; | YFL017C | | 366b | Unclassified Proteins; |
| YDR429C | TIF35 | 367a | Protein Synthesis; Cellular Organization; | YFL017C | | 367b | Unclassified Proteins; |
| YCR02OC-A | MAK31 | 368a | Retrotransposons And Plasmid Proteins; | YEL053C | MAK10 | 368b | Energy; |
| YHR158C | KEL1 | 369a | Sional Transduction; | YOR047C | STD1 | 369b | Metabolism; Transcription; |
| YHR158C | KEL1 | 370a | Signal Transduction; | YJR122W | CAF17 | 370b | Transcription; Cellular Organization; |
| YHR158C | KEL1 | 371a | Signal Transduction; | YMR181C | | 371b | Unclassified Proteins; |
| YCR027C | | 372a | Signal Transduction; | YOL083W | | 372b | Unclassified Proteins; |
| YHL002W | | 373a | Signal Transduction; | YNR005C | | 373b | Unclassified Proteins; |
| YKL166C | TPK3 | 374a | Signal Transduction; Cellular Organization; | YIL033C | SRA1 | 374b | Metabolism; Cell Growth, Cell Division And DNA Synthesis; Cell Rescue, Defense, Cell Death And Aging; Cellular Organization; |
| YDR017C | KCS1 | 375a | Transcription; | YDR099W | BMH2 | 375b | Cell Growth, Cell Division And DNA Synthesis; |
| YOR025W | HST3 | 376a | Transcription; | YLR403W | SFP1 | 376b | Cell Growth, Cell Division And DNA Synthesis; Cellular Organization; |
| YIL105C | | 377a | Transcription; | YER179W | DMC1 | 377b | Cell Growth, Cell Division And DNA Synthesis; Cellular Organization; |
| YDR026C | | 378a | Transcription; | YDR110W | FOB1 | 378b | Cell Growth, Cell Division And DNA Synthesis; Cellular Organization; |
| YIL105C | | 379a | Transcription; | YKL130C | SHE2 | 379b | Cell Growth, Cell Division And DNA Synthesis; Cellular Organization; |
| YML015C | TAF40 | 380a | Transcription; | YDR174W | | 380b | Cellular Organization; |
| YGL150C | INO80 | 381a | Transcription; | YOR355W | GDS1 | 381b | Classification Not Yet Clear-Cut; |
| YGL150C | INO80 | 382a | Transcription; | YDL002C | NHP10 | 382b | Classification Not Yet Clear-Cut; |
| YER127W | LCP5 | 383a | Transcription; | YDR299W | BFR2 | 383b | Intracellular Transpon; |
| YPR107C | YTH1 | 384a | Transcription; | YBR205W | KTR3 | 384b | Metabolism; Protein Destination; |
| YGR221C | NIF3 | 385a | Transcription; | YGR221C | NIF3 | 385b | Transcription; |
| YML015C | TAF40 | 386a | Transcription; | YDR167W | TAF25 | 386b | Transcription; Cellular Organization; |
| YPR107C | YTH1 | 387a | Transcription; | YJR093C | FIP1 | 387b | Transcription; Cellular Organization; |
| YDR439W | LRS4 | 388a | Transcription; | YCR086W | | 388b | Unclassified Proteins; |
| YCR004C | YCP4 | 389a | Transcription; | YDR032C | | 389b | Unclassified Proteins; |
| YER116C | | 390a | Transcription; | YGR024C | | 390b | Unclassified Proteins; |
| YIL105C | | 391a | Transcription; | YNL047C | | 391b | Unclassified Proteins; |
| YIR005W | | 392a | Transcription; | YGL174W | | 392b | Unclassified Proteins; |
| YDR311W | TFB1 | 393a | Transcription; Cell Rescue, Defense, Cell Death And Aging; Cellular Organization; | YGR120C | | 393b | Intracellular Transport; Cellular Organization; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YDR311W | TFB1 | 394a | Transcription; Cell Rescue, Defense, Cell Death And Aging; Cellular Organization; | YKL103C | LAP4 | 394b | Protein Destination; Cellular Organization; |
| YDR311W | TFB1 | 395a | Transcription; Cell Rescue, Defense, Cell Death And Aging; Cellular Organization; | YOL082W | | 395b | Unclassified Proteins; |
| YDR225W | HTA1 | 396a | Transcription; Cellular Organization; | YKR048C | NAP1 | 396b | Cell Growth, Cell Division And DNA Synthesis; Protein Destination; Cellular Biogenesis; Cellular Organization; |
| YMR112C | | 397a | Transcription; Cellular Organization; | YBR253W | SRB6 | 397b | Metabolism; Cell Growth, Cell Division And DNA Synthesis; Transcription; Cellular Organization; |
| YGR208W | SIP2 | 398a | Transcription; Cellular Organization; | YGL115W | SNF4 | 398b | Metabolism; Transcription; Cell Rescue, Defense, Cell Death And Aging; Cellular Organization; |
| YGL122C | NAB2 | 399a | Transcription; Cellular Organization; | YKR026C | GCN3 | 399b | Protein Synthesis; Cellular Organization; |
| YDL160C | DHH1 | 400a | Transcription; Cellular Organization; | YOL149W | DCP1 | 400b | Transcription; |
| YGR158C | MTR3 | 401a | Transcription; Cellular Organization; | YDL111C | RRP42 | 401b | Transcription; |
| YKL028W | TFA1 | 402a | Transcription; Cellular Organization; | YDR311W | TFB1 | 402b | Transcription; Cell Rescue, Defense, Cell Death And Aging; Cellular Organization; |
| YGL237C | HAP2 | 403a | Transcription; Cellular Organization; | YBL021C | HAP3 | 403b | Transcription; Cellular Organization; |
| YGL237C | HAP2 | 404a | Transcription; Cellular Organization; | YOR358W | HAP5 | 404b | Transcription; Cellular Organization; |
| YBL021C | HAP3 | 405a | Transcription; Cellular Organization; | YOR358W | HAP5 | 405b | Transcription; Cellular Organization; |
| YOL123W | HRP1 | 406a | Transcription; Cellular Organization; | YGL122C | NAB2 | 406b | Transcription; Cellular Organization; |
| YOL135C | MED7 | 407a | Transcription; Cellular Organization; | YOR174W | MED4 | 407b | Transcription; Cellular Organization; |
| YPR110C | RPC40 | 408a | Transcription; Cellular Organization; | YNL113W | RPC19 | 408b | Transcription; Cellular Organization; |
| YJL025W | RRN7 | 409a | Transcription; Cellular Organization; | YBL014C | RRN6 | 409b | Transcription; Cellular Organization; |
| YMR270C | RRN9 | 410a | Transcription; Cellular Organization; | YBL025W | RRN10 | 410b | Transcription; Cellular Organization; |
| YOR159C | SME1 | 411a | Transcription; Cellular Organization; | YPR182W | SMX3 | 411b | Transcription; Cellular Organization; |
| YPR182W | SMX3 | 412a | Transcription; Cellular Organization; | YLR275W | SMD2 | 412b | Transcription; Cellular Organization; |
| YGR104C | SRB5 | 413a | Transcription; Cellular Organization; | YBR193C | MED8 | 413b | Transcription; Cellular Organization; |
| YDR308C | SRB7 | 414a | Transcription; Cellular Organization; | YOR174W | ME04 | 414b | Transcription; Cellular Organization; |
| YDR308C | SRB7 | 415a | Transcription; Cellular Organization; | YOL135C | MED7 | 415b | Transcription; Cellular Organization; |
| YGL112C | TAF60 | 416a | Transcription; Cellular Organization; | YMR236W | TAF17 | 416b | Transcription; Cellular Organization; |
| YKL028W | TFA1 | 417a | Transcription; Cellular Organization; | YKR062W | TFA2 | 417b | Transcription; Cellular Organization; |
| YOR210W | RPB10 | 418a | Transcription; Cellular Organization; | YGL166W | CUP2 | 418b | Transcription; Ionic Homeostasis; Cellular Organization; |
| YIR018W | YAP5 | 419a | Transcription; Cellular Organization; | YGL071W | RCS1 | 419b | Transcription; Ionic Homeostasis; Cellular Organization; |
| YDL160C | DHH1 | 420a | Transcription; Cellular Organization; | YEL015W | | 420b | Unclassified Proteins; |
| YPR110C | RPC40 | 421a | Transcription; Cellular Organization; | YLR238W | | 421b | Unclassified Proteins; |
| YDL150W | RPC53 | 422a | Transcription; Cellular Organization; | YKR025W | | 422b | Unclassified Proteins; |
| YDR088C | SLU7 | 423a | Transcription; Cellular Organization; | YDL144C | | 423b | Unclassified Proteins; |
| YMR039C | SUB1 | 424a | Transcription; Cellular Organization; | YMR316C-B | | 424b | Unclassified Proteins; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YGL112C | TAF60 | 425a | Transcription; Cellular Organization; | YMR255W | | 425b | Unclassified Proteins; |
| YDR002W | | 426a | Transcription; Intracellular Transport; Cellular Organization; | YKR048C | NAP1 | 426b | Cell Growth, Cell Division And DNA Synthesis; Protein Destination; Cellular Biogenesis; Cellular Organization; |
| YLR293C | GSP1 | 427a | Transcription; Intracellular Transport; Cellular Organization; | YJR074W | MOG1 | 427b | Unclassified Proteins; |
| YOR185C | GSP2 | 428a | Transcription; Intracellular Transport; Cellular Organization; | YJR074W | MOG1 | 428b | Unclassified Proteins; |
| YLR216C | CPR6 | 429a | Transcription; Protein Destination; Cellular Organization; | YIR037W | HYR1 | 429b | Cell Rescue, Defense, Cell Death And Aging; |
| YBR237W | PRP5 | 430a | Transcription; Protein Destination; Cellular Organization; | YDR073W | SNF11 | 430b | Metabolism; Cell Growth, Cell Division And DNA Synthesis; Transcription; Cellular Organization; |
| YGR252W | GCN5 | 431a | Transcription; Protein Destination; Cellular Organization; | YDR448W | ADA2 | 431b | Transcription; Cellular Organization; |
| YBR052C | | 432a | Transport Facilitation; | YDR032C | | 432b | Unclassified Proteins; |
| YKR104W | | 433a | Transport Facilitation; Cell Rescue, Defense, Cell Death And Aging; | YOL143C | RIB4 | 433b | Metabolism; |
| YLL028W | | 434a | Transport Facilitation; Cell Rescue, Defense, Cell Death And Aging; | YGL166W | CUP2 | 434b | Transcription; Ionic Homeostasis; Cellular Organization; |
| YIL013C | PDR11 | 435a | Transport Facilitation; Cellular Organization; | YDR174W | | 435b | Cellular Organization; |
| YOL130W | ALR1 | 436a | Transport Facilitation; Intracellular Transport; Cell Rescue, Defense, Cell Death And Aging; Ionic Homeostasis; Cellular Organization; | YGL025C | PGD1 | 436b | Cell Growth, Cell Division And DNA Synthesis; Transcription; Cellular Organization; |
| YOL130W | ALR1 | 437a | Transport Facilitation; Intracellular Transport; Cell Rescue, Defense, Cell Death And Aging; Ionic Homeostasis; Cellular Organization; | YLR291C | GCD7 | 437b | Protein Synthesis; Cellular Organization; |
| YMR243C | ZRC1 | 438a | Transport Facilitation; Intracellular Transport; Cell Rescue, Defense, Cell Death And Aging; Ionic Homeostasis; Cellular Organization; | YKL142W | MRP8 | 438b | Protein Synthesis; Cellular Organization; |
| YOL130W | ALR1 | 439a | Transport Facilitation; Intracellular Transport; Cell Rescue, Defense, Cell Death And Aging; Ionic Homeostasis; Cellular Organization; | YGL024W | | 439b | Unclassified Proteins; |
| YOL130W | ALR1 | 440a | Transport Facilitation; Intracellular Transport; Cell Rescue, Defense, Cell Death And Aging; Ionic Homeostasis; Cellular Organization; | YNL086W | | 440b | Unclassified Proteins; |
| YFL060C | SNO3 | 441a | Unclassified Proteins; | YMR096W | SNZ1 | 441b | Cell Growth, Cell Division And DNA Synthesis; |
| YDL012C | | 442a | Unclassified Proteins; | YDR151C | CTH1 | 442b | Cell Growth, Cell Division And DNA Synthesis; |
| YIL065C | | 443a | Unclassified Proteins; | YJR091C | JSN1 | 443b | Cell Growth, Cell Division And DNA Synthesis; |
| YLR392C | | 444a | Unclassified Proteins; | YJR091C | JSN1 | 444b | Cell Growth, Cell Division And DNA Synthesis; |
| YDR214W | | 445a | Unclassified Proteins; | YJL030W | MAD2 | 445b | Cell Growth, Cell Division And DNA Synthesis; |
| YNL127W | | 446a | Unclassified Proteins; | YKR055W | RHO4 | 446b | Cell Growth, Cell Division And DNA Synthesis; |
| YGR278W | | 447a | Unclassified Proteins; | YGR049W | SCM4 | 447b | Cell Growth, Cell Division And DNA Synthesis; |
| YMR322C | | 448a | Unclassified Proteins; | YMR096W | SNZ1 | 448b | Cell Growth, Cell Division And DNA Synthesis; |
| YBR190W | | 449a | Unclassified Proteins; | YLR117C | SYF3 | 449b | Cell Growth, Cell Division And DNA Synthesis; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YDL012C | | 450a | Unclassified Proteins; | YJL065C | | 450b | Cell Growth, Cell Division And DNA Synthesis; |
| YNR029C | | 451a | Unclassified Proteins; | YJL065C | | 451b | Cell Growth, Cell Division And DNA Synthesis; |
| YGL061C | DUO1 | 452a | Unclassified Proteins; | YER016W | BIM1 | 452b | Cell Growth, Cell Division And DNA Synthesis; Cellular Biogenesis; Cellular Organization; |
| YOR353C | | 453a | Unclassified Proteins; | YHR102W | NRKl1 | 453b | Cell Growth, Cell Division And DNA Synthesis; Cellular Biogenesis; |
| YBR141C | | 454a | Unclassified Proteins; | YGL091C | NBP35 | 454b | Cell Growth, Cell Division And DNA Synthesis; Cellular Organization; |
| YGR154C | | 455a | Unclassified Proteins; | YCR057C | PWP2 | 455b | Cell Growth, Cell Division And DNA Synthesis; Cellular Organization; |
| YGR017W | | 456a | Unclassified Proteins; | YLR403W | SFPl | 456b | Cell Growth, Cell Division And DNA Synthesis; Cellular Organization; |
| YJL048C | | 457a | Unclassified Proteins; | YKL130C | SHE2 | 457b | Cell Growth, Cell Division And DNA Synthesis; Cellular Organization; |
| YPR020W | | 458a | Unclassified Proteins; | YKL130C | SHE2 | 458b | Cell Growth, Cell Division And DNA Synthesis; Cellular Organization; |
| YDL239C | | 459a | Unclassified Proteins; | YHR184W | SSP1 | 459b | Cell Growth, Cell Division And DNA Synthesis; Cellular Organization; |
| YNL078W | | 460a | Unclassified Proteins; | YKR048C | NAP1 | 460b | Cell Growth, Cell Division And DNA Synthesis; Protein Destination; Cellular Biogenesis; Cellular Organization; |
| YDR315C | | 461a | Unclassified Proteins; | YJR117W | STE24 | 461b | Cell Growth, Cell Division And DNA Synthesis; Protein Destination; Cellular Organization; |
| YLR200W | YKE2 | 462a | Unclassified Proteins; | YMR052W | FAR3 | 462b | Cell Growth, Cell Division And DNA Synthesis; Signal Transduction; |
| YDR200C | | 463a | Unclassified Proteins; | YMR052W | FAR3 | 463b | Cell Growth, Cell Division And DNA Synthesis; Signal Transduction; |
| YDR032C | | 464a | Unclassified Proteins; | YCL032W | STE50 | 464b | Cell Growth, Cell Division And DNA Synthesis; Signal Transduction; |
| YNL127W | | 465a | Unclassified Proteins; | YAL016W | TPD3 | 465b | Cell Growth, Cell Division And DNA Synthesis; Transcription; |
| YIL065C | | 466a | Unclassified Proteins; | YLR321C | SFH1 | 466b | Cell Growth, Cell Division And DNA Synthesis; Transcription; Cellular Biogenesis; Cellular Organization; |
| YIL132C | | 467a | Unclassified Proteins; | YLR321C | SFH1 | 467b | Cell Growth, Cell Division And DNA Synthesis; Transcription; Cellular Biogenesis; Cellular Organization; |
| YGL230C | | 468a | Unclassified Proteins; | YKL110C | KTI12 | 466b | Cell Rescue, Defense, Cell Death And Aging; |
| YBL101W-A | | 469a | Unclassified Proteins; | YBL043W | ECM13 | 469b | Cellular Biogenesis; |
| YGR068C | | 470a | Unclassified Proteins; | YBL102W | SFT2 | 470b | Cellular Organization; |
| YKL090W | | 471a | Unclassified Proteins; | YPL128C | TBF1 | 471b | Cellular Organization; |
| YPR260W | | 472a | Unclassified Proteins; | YIL144W | TID3 | 472b | Cellular Organization; |
| YKL002W | | 473a | Unclassified Proteins; | YMR117C | | 473b | Cellular Organization; |
| YBR141C | | 474a | Unclassified Proteins; | YDR372C | | 474b | Cellular Organization; Unclassified Proteins; |
| YMR095C | SNO1 | 475a | Unclassified Proteins; | YNL333W | SNZ2 | 475b | Classification Not Yet Clear-Cut; |
| YFL060C | SNO3 | 476a | Unclassified Proteins; | YNL333W | SNZ2 | 476b | Classification Not Yet Clear-Cut; |
| YDL012C | | 477a | Unclassified Proteins; | YOR355W | GDS1 | 477b | Classlfication Not Yet Clear-Cut; |
| YNL091W | | 478a | Unclassified Proteins; | YOR355W | GDS1 | 478b | Classification Not Yet Clear-Cut; |
| YMR312W | | 479a | Unclassified Proteins; | YHR187W | IKI1 | 479b | Classification Not Yet Clear-Cut; |
| YMR322C | | 480a | Unclassified Proteins; | YNL333W | SNZ2 | 480b | Classification Not Yet Clear-Cut; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YMR322C | | 481a | Unclassified Proteins; | YFL059W | SNZ3 | 481b | Classification Not Yet Clear-Cut; |
| YDR071C | | 482a | Unclassified Proteins; | YBR125C | | 482b | Classification Not Yet Clear-Cut; |
| YDR482C | | 483a | Unclassified Proteins; | YGL028C | | 483b | Classification Not Yet Clear-Cut; |
| YMR102C | | 484a | Unclassified Proteins; | YNR218W | | 484b | Classification Not Yet Clear-Cut; |
| YJL112W | | 485a | Unclassified Proteins; | YLL001W | DNM1 | 485b | Intracelular Transport; Cellular Biogenesis; |
| YDR472W | | 486a | Unclassified Proteins; | YKR068C | BET3 | 486b | Intracellular Transport; Cellular Organization; |
| YDR128W | | 487a | Unclassified Proteins; | YLR208W | SEC13 | 487b | Intracellular Transport; Cellular Organization; |
| YPR105C | | 488a | Unclassified Proteins; | YGL145W | TIP20 | 488b | Intracellular Transport; Cellular Organization; |
| YAL034W-A | | 489a | Unclassified Proteins; | YGR120C | | 489b | Intracellular Transport; Cellular Organization; |
| YDR472W | | 490a | Unclassified Proteins; | YBR254C | | 490b | Intracellular Transport; Cellular Organization; |
| YER157W | | 491a | Unclassified Proteins; | YGR120C | | 491b | Intracellular Transport; Cellular Organization; |
| YNR025C | | 492a | Unclassified Proteins; | YGR120C | | 492b | Intracellular Transport; Cellular Organization; |
| YOR353C | | 493a | Unclassified Proteins; | YGR120C | | 493b | Intracellular Transport; Cellular Organization; |
| YPR105C | | 494a | Unclassified Proteins; | YGR120C | | 494b | Intracellular Transport; Cellular Organization; |
| YFL010C | | 495a | Unclassified Proteins; | YDR515W | SLF1 | 495b | Ionic Homeostasis; |
| YEL041W | | 496a | Unclassified Proteins; | YJR049C | UTR1 | 496b | Ionic Homeostasis; |
| YGR163W | GTR1 | 497a | Unclassified Proteins; | YML121W | GTR1 | 497b | Metabolism; |
| YNL311C | | 498a | Unclassified Proteins; | YKL001C | MET14 | 498b | Metabolism; |
| YOR138C | | 499a | Unclassified Proteins; | YEL062W | NPR2 | 499b | Metabolism; |
| YLL062C | | 500a | Unclassified Proteins; | YOL143C | RIB4 | 500b | Metabolism; |
| YBL101W-A | | 501a | Unclassified Proteins; | YNR229C | URE2 | 501b | Metabolism; |
| YDL012C | | 502a | Unclassified Proteins; | YFR047C | | 502b | Metabolism; |
| YDR132C | | 503a | Unclassified Proteins; | YJL218W | | 503b | Metabolism; |
| YGR294W | | 504a | Unclassified Proteins; | YHL018W | | 504b | Metabolism; |
| YIL008W | | 505a | Unclassified Proteins; | YHR111W | | 505b | Metabolism; |
| YNL311C | | 506a | Unclassified Proteins; | YIL074C | | 506b | Metabolism; |
| YFR042W | | 507a | Unclassified Proteins; | YPR159W | KRE6 | 507b | Metabolism; Cell Growth, Cell Division And DNA Synthesis; Cellular Biogenesis; Cellular Organization; |
| YML088W | | 508a | Unclassified Proteins; | YDR328C | SKP1 | 508b | Metabolism; Cell Growth, Cell Division And DNA Synthesis; Protein Destination; Cellular Organization; |
| YGR122W | | 509a | Unclassified Proteins; | YLR025W | SNF7 | 509b | Metabolism; Cell Growth, Cell Division And DNA Synthesis; Protein Destination; Cellular Organization; |
| YMR025W | | 510a | Unclassified Proteins; | YNR052C | POP2 | 510b | Metabolism; Cell Growth, Cell Division And DNA Synthesis; Transcription; Cellular Organization; |
| YML068W | | 511a | Unclassified Proteins; | YDR073W | SNF11 | 511b | Metabolism; Cell Growth, Cell Division And DNA Synthesis; Transcription; Cellular Organization; |
| YNL094W | | 512a | Unclassified Proteins; | YNL025C | SSN8 | 512b | Metabolism; Cell Growth, Cell Division And DNA Synthesis; Transcription; Cellular Organization; |
| YDR215C | | 513a | Unclassified Proteins; | YPL175W | SPT14 | 513b | Metabolism; Cellular Biogenesis; Cellular Organization; |
| YAL032C | FUN20 | 514a | Unclassified Proteins; | YLR345W | | 514b | Metabolism; Energy; |
| YLR465C | | 515a | Unclassified Proteins; | YML035C | AMD1 | 515b | Metabolism; Energy; |
| YDL012C | | 516a | Unclassified Proteins; | YIL172C | | 516b | Metabolism; Energy; |
| YAR014C | | 517a | Unclassified Proteins; | YER133W | GLC7 | 517b | Metabolism; Energy; Cell Growth, Cell Division And DNA Synthesis; Protein Synthesis; Cellular Organization; |
| YML053C | | 518a | Unclassified Proteins; | YJR009C | TDH2 | 518b | Metabolism; Energy; Cellular Organization; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YGR058W | | 519a | Unclassified Proteins; | YLR113W | HOG1 | 519b | Metabolism; Signal Transduction; Cell Rescue, Defense, Cell Death And Aging; |
| YCL046W | | 520a | Unclassified Proteins; | YGL115W | SNF4 | 520b | Metabolism; Transcription; Cell Rescue, Defense, Cell Death And Aging; Cellular Organization; |
| YPL039W | MET31 | 521a | Unclassified Proteins; | YEL009C | GCN4 | 521b | Metabolism; Transcription; Cellular Organization; |
| YGR242C | | 522a | Unclassified Proteins; | YKR099W | BAS1 | 522b | Metabolism; Transcription; Cellular Organization; |
| YDL076C | | 523a | Unclassified Proteins; | YLR098C | CHA4 | 523b | Metabolism; Transcription; Cellular Organization; |
| YDL239C | | 524a | Unclassified Proteins; | YLR098C | CHA4 | 524b | Metabolism; Transcription; Cellular Organization; |
| YHR145C | | 525a | Unclassified Proteins; | YEL009C | GCN4 | 525b | Metabolism; Transcription; Cellular Organization; |
| YDL110C | | 526a | Unclassified Proteins; | YKL015W | PUT3 | 526b | Metabolism; Transcription; Cellular Organization; |
| YGL230C | | 527a | Unclassified Proteins; | YDL210W | UGA4 | 527b | Metabolism; Transport Facilitation; Intracellular Transport; Cellular Organization; |
| YPR222W | | 528a | Unclassified Proteins; | YGR048W | UFD1 | 528b | Protein Destination; |
| YIL151C | | 529a | Unclassified Proteins; | YLR121C | YPS4 | 529b | Protein Destination; |
| YLL049W | | 530a | Unclassified Proteins; | YNR069C | | 530b | Protein Destination; |
| YNR068C | | 531a | Unclassified Proteins; | YNR069C | | 531b | Protein Destination; |
| YAR031W | | 532a | Unclassified Proteins; | YBR217W | | 532b | Protein Destination; Cellular Biogenesis; Cellular Organization; |
| YAL034W-A | | 533a | Unclassified Proteins; | YKL103C | LAP4 | 533b | Protein Destination; Cellular Organization; |
| YPL019C | | 534a | Unclassified Proteins; | YHR060W | VMA22 | 534b | Protein Destination; Cellular Organization; |
| YPR105C | | 535a | Unclassified Proteins; | YHR060W | VMA22 | 535b | Protein Destination; Cellular Organization; |
| YOL105C | WSC3 | 536a | Unclassified Proteins; | YGL153W | PEX14 | 536b | Protein Destination; Intracellular Transport; Cellular Organization; |
| YBR077C | | 537a | Unclassified Proteins; | YMR004W | MVP1 | 537b | Protein Destination; Intracellular Transport; Cellular Organization; |
| YPL151C | | 538a | Unclassified Proteins; | YOR036W | PEP12 | 538b | Protein Destination; Intracellular Transport; Cellular Organization; |
| YPR105C | | 539a | Unclassified Proteins; | YGL153W | PEX14 | 539b | Protein Destination; Intracellular Transport; Cellular Organization; |
| YDR482C | | 540a | Unclassified Proteins; | YOR276W | CAF20 | 540b | Protein Synthesis; Cellular Organization; |
| YBR270C | | 541a | Unclassified Proteins; | YKR026C | GCN3 | 541b | Protein Synthesis; Cellular Organization; |
| YER186C | | 542a | Unclassified Proteins; | YKR026C | GCN3 | 542b | Protein Synthesis; Cellular Organization; |
| YMR269W | | 543a | Unclassified Proteins; | YKR026C | GCN3 | 543b | Protein Synthesis; Cellular Organization; |
| YER082C | | 544a | Unclassified Proteins; | YKL142W | MRP8 | 544b | Protein Synthesis; Cellular Organization; |
| YMR210W | | 545a | Unclassified Proteins; | YKL142W | MRP8 | 545b | Protein Synthesis; Cellular Organization; |
| YDL063C | | 546a | Unclassified Proteins; | YPL131W | RPL5 | 546b | Protein Synthesis; Cellular Organization; |
| YLL027W | | 547a | Unclassified Proteins; | YGL189C | RPS26A | 547b | Protein Synthesis; Cellular Organization; |
| YLL027W | | 548a | Unclassified Proteins; | YER131W | RPS26B | 548b | Protein Synthesis; Cellular Organization; |
| YDR315C | | 549a | Unclassified Proteins; | YLR264W | RPS28B | 549b | Protein Synthesis; Cellular Organization; |
| YCL020W | | 550a | Unclassified Proteins; | YFL002W-A | | 550b | Retrotransposons And Plasmid Proteins; |
| YFL010C | | 551a | Unclassified Proteins; | YGR136W | | 551b | Signal Transduction; Cellular Organization; |
| YGR058W | | 552a | Unclassified Proteins; | YGR136W | | 552b | Signal Transduction; Cellular Organization; |
| YDR416W | SYF1 | 553a | Unclassified Proteins; | YBR188C | NTC20 | 553b | Transcription; |
| YDR215C | | 554a | Unclassified Proteins; | YKR024C | DBP7 | 554b | Transcription; |
| YDR132C | | 555a | Unclassified Proteins; | YHR170W | NMD3 | 555b | Transcription; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YBR270C | | 556a | Unclassified Proteins; | YIL105C | | 556b | Transcription; |
| YDL146W | | 557a | Unclassified Proteins; | YKL070W | | 557b | Transcription; |
| YDR326C | | 558a | Unclassified Proteins; | YIL105C | | 558b | Transcription; |
| YGR250C | | 559a | Unclassified Proteins; | YIR001C | | 559b | Transcription; |
| YMR068W | | 560a | Unclassified Proteins; | YIL105C | | 560b | Transcription; |
| YPR082C | DIB1 | 561a | Unclassified Proteins; | YBR055C | PRP6 | 561b | Transcription; Cellular Organization; |
| YDR313C | PIB1 | 562a | Unclassified Proteins; | YPL133C | YPL133C | 562b | Transcription; Cellular Organization; |
| YGR068C | | 563a | Unclassified Proteins; | YGL015W | CKB1 | 563b | Transcription; Cellular Organization; |
| YMR255W | | 564a | Unclassified Proteins; | YGL122C | NAB2 | 564b | Transcription; Cellular Organization; |
| YDL098C | | 565a | Unclassified Proteins; | YGR075C | PRP38 | 565b | Transcription; Cellular Organization; |
| YFL023W | | 566a | Unclassified Proteins; | YBR154C | RPB5 | 566b | Transcription; Cellular Organization; |
| YDR255C | | 567a | Unclassified Proteins; | YKL144C | RPC25 | 567b | Transcription; Cellular Organization; |
| YDR357C | | 568a | Unclassified Proteins; | YPR182W | SMX3 | 568b | Transcription; Cellular Organization; |
| YOL106W | | 569a | Unclassified Proteins; | YPR182W | SMX3 | 569b | Transcription; Cellular Organization; |
| YBR270C | | 570a | Unclassified Proteins; | YMR236W | TAF17 | 570b | Transcription; Cellular Organization; |
| YML114C | | 571a | Unclassified Proteins; | YDR167W | TAF25 | 571b | Transcription; Cellular Organization; |
| YDL063C | | 572a | Unclassified Proteins; | YDR381W | YRA1 | 572b | Transcription; Cellular Organization; |
| YNL171C | | 573a | Unclassified Proteins; | YCR106W | | 573b | Transcription; Cellular Organization; |
| YAL034W-A | | 574a | Unclassified Proteins; | YGL172W | NUP49 | 574b | Transcription; Intracellular Transport; Cellular Organization; |
| YKR011C | | 575a | Unclassified Proteins; | YGL166W | CUP2 | 575b | Transcription; Ionic Homeostasis; Cellular Organization; |
| YML006C | | 576a | Unclassified Proteins; | YGL166W | CUP2 | 576b | Transcription; Ionic Homeostasis; Cellular Organization; |
| YOR220W | | 577a | Unclassified Proteins; | YGL166W | CUP2 | 577b | Transcription; Ionic Homeostasis; Cellular Organization; |
| YHL006C | | 578a | Unclasstfied Proteins; | YNL021W | HDA1 | 578b | Transcription; Protein Destination; Cellular Organization; |
| YDL012C | | 579a | Unclassified Proteins; | YHR032W | | 579b | Transport Facilitation; Cell Rescue, Defense, Cell Death And Aging; |
| YMR075C-A | | 580a | Unclassified Proteins; | YCR023C | | 580b | Transport Facilitation; Cell Rescue, Defense, Cell Death And Aging; |
| YGR113W | DAM1 | 581a | Unclassified Proteins; | YGL061C | DUO1 | 581b | Unclassified Proteins; |
| YGL061C | DUO1 | 582a | Unclassified Proteins; | YDR016C | | 582b | Unclassified Proteins; |
| YAL036C | FUN11 | 583a | Unclassified Proteins; | YDR152W | | 583b | Unclassified Proteins; |
| YAL032C | FUN20 | 584a | Unclassified Proteins; | YPL151C | | 584b | Unclassified Proteins; |
| YDR490C | PKH1 | 585a | Unclassified Proteins; | YHR207C | | 585b | Unclassified Proteins; |
| YDR490C | PKH1 | 586a | Unclassified Proteins; | YIR044C | | 586b | Unclassified Proteins; |
| YDR490C | PKH1 | 587a | Unclassified Proteins; | YLR466W | | 587b | Unclassified Proteins; |
| YLR082C | SRL2 | 588a | Unclassified Proteins; | YLR082C | SRL2 | 588b | Unclassified Proteins; |
| YDR416W | SYF1 | 589a | Unclassified Proteins; | YJR050W | ISY1 | 589b | Unclassified Proteins; |
| YDR416W | SYF1 | 590a | Unclassified Proteins; | YCR129W | SYF2 | 590b | Unclassified Proteins; |
| YHR016C | YSC84 | 591a | Unclassified Proteins; | YLR243W | | 591b | Unclassified Proteins; |
| YHR016C | YSC84 | 592a | Unclassified Proteins; | YMR255W | | 592b | Unclassified Proteins; |
| YHL006C | | 593a | Unclassified Proteins; | YDR078C | PUN1 | 593b | Unclassified Proteins; |
| YNL056W | | 594a | Unclassified Proteins; | YNL032W | SIW14 | 594b | Unclassified Proteins; |
| YFL023W | | 595a | Unclassified Proteins; | YLR200W | YKE2 | 595b | Unclassified Proteins; |
| YAR031W | | 596a | Unclassified Proteins; | YCR030C | | 596b | Unclassified Proteins; |
| YBL101W-A | | 597a | Unclassified Proteins, | YFL002W-A | | 597b | Unclassified Proteins, |
| YBL101W-A | | 598a | Unclassified Proteins; | YJL162C | | 598b | Unclassified Proteins; |
| YBR103W | | 599a | Unclassified Proteins; | YIL112W | | 599b | Unclassified Proteins; |
| YBR228W | | 600a | Unclassified Proteins; | YLR135W | | 600b | Unclassified Proteins; |
| YDL012C | | 601a | Unclassified Proteins; | YHR140W | | 601b | Unclassified Proteins; |
| YDL071C | | 602a | Unclassified Proteins; | YDR183W | | 602b | Unclassified Proteins; |
| YDL071C | | 603a | Unclassified Proteins; | YEL068C | | 603b | Unclassified Proteins; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YDL071C | | 604a | Unclassified Proteins; | YFL017C | | 604b | Unclassified Proteins; |
| YDL071C | | 605a | Unclassified Proteins; | YGR269W | | 605b | Unclassified Proteins; |
| YDL071C | | 606a | Unclassified Proteins; | YNL155W | | 606b | Unclassified Proteins; |
| YDL089W | | 607a | Unclassified Proteins; | YDL089W | | 607b | Unclassified Proteins; |
| YDL089W | | 608a | Unclassified Proteins; | YLR324W | | 608b | Unclassified Proteins; |
| YDL089W | | 609a | Unclassified Proteins; | YMR316C-B | | 609b | Unclassified Proteins; |
| YDL110C | | 610a | Unclassified Proteins; | YOR078W | | 610b | Unclassified Proteins; |
| YDL113C | | 611a | Unclassified Proteins; | YJL036W | | 611b | Unclassified Proteins; |
| YDL133W | | 612a | Unclassified Proteins; | YDL001W | | 612b | Unclassified Proteins; |
| YDR216C | | 613a | Unclassified Proteins; | YMR025W | | 613b | Unclassified Proteins; |
| YDR239C | | 614a | Unclassified Proteins; | YOL091W | | 614b | Unclassified Proteins; |
| YDR013W | | 615a | Unclassified Proteins; | YDR489W | | 615b | Unclassified Proteins; |
| YDR032C | | 616a | Unclassified Proteins; | YDR032C | | 616b | Unclassified Proteins; |
| YDR051C | | 617a | Unclassified Proteins; | YDR051C | | 617b | Unclassified Proteins; |
| YDR070C | | 618a | Unclassified Proteins; | YFL017C | | 618b | Unclassified Proteins; |
| YDR179C | | 619a | Unclassified Proteins; | YMR025W | | 619b | Unclassified Proteins; |
| YDR200C | | 620a | Unclassified Proteins; | YNL127W | | 620b | Unclassified Proteins; |
| YDR236C | | 621a | Unclassified Proteins; | YDR398W | | 621b | Unclassified Proteins; |
| YDR267C | | 622a | Unclassified Proteins; | YHR122W | | 622b | Unclassified Proteins; |
| YDR279W | | 623a | Unclassified Proteins; | YLR154C | | 623b | Unclassified Proteins; |
| YDR315C | | 624a | Unclassified Proteins; | YLR323C | | 624b | Unclassified Proteins; |
| YDR315C | | 625a | Unclassified Proteins; | YOR078W | | 625b | Unclassified Proteins; |
| YDR326C | | 626a | Unclassified Proteins, | YER007C-A | | 626b | Unclassified Proteins, |
| YDR348C | | 627a | Unclassified Proteins; | YMR295C | | 627b | Unclassified Proteins; |
| YEL023C | | 628a | Unclassified Proteins; | YDL011C | | 628b | Unclassified Proteins; |
| YER010C | | 629a | Unclassified Proteins; | YER010C | | 629b | Unclassified Proteins; |
| YER046W | | 630a | Unclassified Proteins; | YFL017C | | 630b | Unclassified Proteins; |
| YER063W | | 631a | Unclassified Proteins; | YAL049C | | 631b | Unclassified Proteins; |
| YER106W | | 632a | Unclassified Proteins; | YCR086W | | 632b | Unclassified Proteins; |
| YFL010C | | 633a | Unclassified Proteins; | YOR197W | | 633b | Unclassified Proteins; |
| YFR043C | | 634a | Unclassified Proteins; | YDR489W | | 634b | Unclassified Proteins; |
| YGL051W | | 635a | Unclassified Proteins; | YAR033W | | 635b | Unclassified Proteins; |
| YGL198W | | 636a | Unclassified Proteins; | YGL161C | | 636b | Unclassified Proteins; |
| YGR214W | | 637a | Unclassified Proteins; | YLR435W | | 637b | Unclassified Proteins; |
| YGR230C | | 638a | Unclassified Proteins; | YOR161C | | 638b | Unclassified Proteins; |
| YGR010W | | 639a | Unclassified Proteins; | YGR010W | | 639b | Unclassified Proteins; |
| YGR017W | | 640a | Unclassified Proteins; | YLR072W | | 640b | Unclassified Proteins; |
| YGR024C | | 641a | Unclassified Proteins; | YGR024C | | 641b | Unclassified Proteins; |
| YGR058W | | 642a | Unclassified Proteins; | YGR058W | | 642b | Unclassified Proteins; |
| YGR058W | | 643a | Unclassified Proteins; | YNL047C | | 643b | Unclassified Proteins; |
| YGR173W | | 644a | Unclassified Proteins; | YDR152W | | 644b | Unclassified Proteins; |
| YIL007C | | 645a | Unclassified Proteins; | YHR185C | | 645b | Unclassified Proteins; |
| YIL082W | | 646a | Unclassified Proteins; | YGR024C | | 646b | Unclassified Proteins; |
| YIL132C | | 647a | Unclassified Proteins; | YLR322W | | 647b | Unclassified Proteins; |
| YIL132C | | 648a | Unclassified Proteins; | YLR376C | | 648b | Unclassified Proteins; |
| YIL151C | | 649a | Unclassified Proteins; | YBL051C | | 649b | Unclassified Proteins; |
| YIL151C | | 650a | Unclassified Proteins; | YDR140W | | 650b | Unclassified Proteins; |
| YJR024C | | 651a | Unclassified Proteins; | YJR024C | | 651b | Unclassified Proteins; |
| YJR072C | | 652a | Unclassified Proteins; | YLR243W | | 652b | Unclassified Proteins; |
| YJR072C | | 653a | Unclassified Proteins; | YOR262W | | 653b | Unclassified Proteins; |
| YJR125C | | 654a | Unclassified Proteins; | YOR111W | | 654b | Unclassified Proteins; |
| YJR136C | | 655a | Unclassified Proteins; | YKL033W | | 655b | Unclassified Proteins; |
| YKL090W | | 656a | Unclassified Proteins; | YGR024C | | 656b | Unclassified Proteins; |
| YKR007W | | 657a | Unclassified Proteins, | YBR077C | | 657b | Unclassified Proteins, |
| YKR022C | | 658a | Unclassified Proteins; | YBL010C | | 658b | Unclassified Proteins; |
| YKR060W | | 659a | Unclassified Proteins; | YDR179C | | 659b | Unclassified Proteins; |
| YKR083C | | 660a | Unclassified Proteins; | YKL052C | | 660b | Unclassified Proteins; |
| YLR015W | | 661a | Unclassified Proteins; | YDR469W | | 661b | Unclassified Proteins; |
| YLR065C | | 662a | Unclassified Proteins; | YDL149W | | 662b | Unclassified Proteins; |
| YLR315W | | 663a | Unclassified Proteins; | YDR383C | | 663b | Unclassified Proteins; |
| YLR328W | | 664a | Unclassified Proteins; | YGR010W | | 664b | Unclassified Proteins; |
| YLR328W | | 665a | Unclassified Proteins; | YLR328W | | 665b | Unclassified Proteins; |
| YLR424W | | 666a | Unclassified Proteins; | YKR022C | | 666b | Unclassified Proteins; |
| YML119W | | 667a | Unclassified Proteins; | YLL032C | | 667b | Unclassified Proteins; |
| YMR093W | | 668a | Unclassified Proteins; | YDR398W | | 668b | Unclassified Proteins; |
| YNL056W | | 669a | Unclassified Proteins; | YNL099C | | 669b | Unclassified Proteins; |
| YNL086W | | 670a | Unclassified Proteins; | YKL061W | | 670b | Unclassified Proteins; |
| YNL091W | | 671a | Unclassified Proteins; | YKL075C | | 671b | Unclassified Proteins; |
| YNL091W | | 672a | Unclassified Proteins; | YNL164C | | 672b | Unclassified Proteins; |
| YNL091W | | 673a | Unclassified Proteins; | YNL288W | | 673b | Unclassified Proteins; |

TABLE 3-continued

Protein Pairs Identified in the Screen.

| Binding Domain Fusion "Bait" [ORF] | Binding Domain Fusion [Gene] | Pro-Pair Ref. No. | Functional Classification (MIPS) | Activation Domain Fusion "Prey" [ORF] | Activation Domain Fusion [Gene] | Pro-Pair Ref. No. | Functional Classification (MIPS) |
|---|---|---|---|---|---|---|---|
| YNL091W | | 674a | Unclassified Proteins; | YPR229W | | 674b | Unclassified Proteins; |
| YNL094W | | 675a | Unclassified Proteins; | YAL049C | | 675b | Unclassified Proteins; |
| YNL122C | | 676a | Unclassified Proteins; | YKL061W | | 676b | Unclassified Proteins; |
| YNR004W | | 677a | Unclassified Proteins; | YPL157W | | 677b | Unclassified Proteins; |
| YNR029C | | 678a | Unclassified Proteins; | YJL064W | | 678b | Unclassified Proteins; |
| YOL070C | | 679a | Unclassified Proteins; | YNL078W | | 679b | Unclassified Proteins; |
| YOR023C | | 680a | Unclassified Proteins; | YCR082W | | 680b | Unclassified Proteins; |
| YCR138C | | 681a | Unclassified Proteins, | YGR268C | | 681b | Unclassified Proteins; |
| YOR215C | | 682a | Unclassified Proteins; | YHR115C | | 682b | Unclassified Proteins; |
| YOR264W | | 683a | Unclassified Proteins; | YCR086W | | 683b | Unclassified Proteins; |
| YOR264W | | 684a | Unclassified Proteins; | YGR058W | | 684b | Unclassified Proteins; |
| YOR353C | | 685a | Unclassified Proteins; | YOL082W | | 685b | Unclassified Proteins; |
| YPL110C | | 686a | Unclassified Proteins; | YGR024C | | 686b | Unclassified Proteins; |
| YPL192C | | 687a | Unclassified Proteins; | YPL192C | | 687b | Unclassified Proteins; |
| YPR105C | | 688a | Unclassified Proteins; | YLR315W | | 688b | Unclassified Proteins; |
| YPR105C | | 689a | Unclassified Proteins; | YMR181C | | 689b | Unclassified Proteins; |
| YPR105C | | 690a | Unclassified Proteins; | YOR164C | | 690b | Unclassified Proteins; |
| YPR105C | | 691a | Unclassified Proteins; | YOR331C | | 691b | Unclassified Proteins; |
| YPR152C | | 692a | Unclassified Proteins; | YBR194W | | 692b | Unclassified Proteins; |

In certain embodiments, the first polypeptide is labeled. In other embodiments, the second polypeptide is labeled, while in some embodiments, both the first and second polypeptides are labeled. Labeling can be performed using any art recognized method for labeling polypeptides. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^{3}H$.

The invention also includes complexes of two or more polypeptides in which at least one of the polypeptides is present as a fragment of a complex-forming polypeptide according to the invention. For example, one or more polypeptides may include an amino acid sequence sufficient to bind to its corresponding polypeptide. A binding domain of a given first polypeptide can be any number of amino acids sufficient to specifically bind to, and complex with, the corresponding second polypeptide under conditions suitable for complex formation. The binding domain can be the minimal number of amino acids required to retain binding affinity, or may be a larger fragment or derivative of the polypeptides listed in Table 3, columns 1 and 4. Procedures for identifying binding domains can be readily identified by one of ordinary skill in the art and the procedures described herein. For example, nucleic acid sequences containing various portions of a "bait" protein can be tested in a yeast two hybrid screening assay in combination with a nucleic acid encoding the corresponding "prey" protein.

In certain embodiments, the "bait" polypeptides of the complex are polypeptides categorized, for example, as a "Metabolism" protein in the MIPS database. In some embodiments, the "prey" protein of the complex is also a "Metabolism" protein, while in other embodiments the "prey" protein is, for example, an "Unclassified" protein (see Table 3; e.g., ProPair 195a–310a and ProPair 195b–310b). Other MIPS categories include, e.g., "Cell Growth/Cell Division/DNA Synthesis" proteins (see Table 2).

In other embodiments, the complexes are human ortholog complexes, chimeric complexes, or specific complexes implicated in fungal pathways, as discussed in detail below.

Polypeptides forming the complexes according to the invention can be made using techniques known in the art. For example, one or more of the polypeptides in the complex can be chemically synthesized using art-recognized methods for polypeptide synthesis. These methods are common in the art, including synthesis using a peptide synthesizer. See, e.g., *Peptide Chemistry, A Practical Textbook*, Bodasnsky, Ed. Springer-Verlag, 1988; Merrifield, *Science* 232: 241–247 (1986); Barany, et al, *Intl. J. Peptide Protein Res.* 30: 705–739 (1987); Kent, *Ann. Rev. Biochem.* 57:957–989 (1988), and Kaiser, et al, *Science* 243: 187–198 (1989).

Alternatively, polypeptides can be made by expressing one or both polypeptides from a nucleic acid and allowing the complex to form from the expressed polypeptides. Any known nucleic acids that express the polypeptides, whether yeast or human (or chimerics of these polypeptides) can be used, as can vectors and cells expressing these polypeptides. Sequences of yeast ORFs and human polypeptides as referenced in Tables 3 and 7 are publicly available, e.g. at the Saccharomyces Genome Database (SGD) and GenBank (see, e.g. Hudson et al., *Genome Res*. 7: 1169–1173 (1997). If desired, the complexes can then be recovered and isolated.

Recombinant cells expressing the polypeptide, or a fragment or derivative thereof, may be obtained using methods known in the art, and individual gene product or complex may be isolated and analyzed (See, e.g., e.g., as described in Sambrook et al., eds., MOLECULAR CLONING: A LABORATORY MANUAL, 2nd Ed., Cold Spring Harbor Laboratory Press, Cold Spring Harbor, N.Y., 1989; and Ausubel, et al., eds., CURRENT PROTOCOLS IN MOLECULAR BIOLOGY, John Wiley & Sons, New York, N.Y., 1993). This is achieved by assays that are based upon the physical and/or functional properties of the protein or complex. The assays can include, e.g., radioactive labeling of one or more of the polypeptide complex components, followed by analysis by gel electrophoresis, immunoassay, cross-linking to marker-labeled products. Polypeptide complex may be isolated and purified by standard methods known in the art (either from natural sources or recombinant host cells expressing the proteins/protein complex). These methods can include, e.g., column chromatography (e.g., ion exchange, affinity, gel exclusion, reverse-phase, high pressure, fast protein liquid, etc), differential centrifugation, differential solubility, or similar methods used for the purification of proteins.

Complexes Useful for Identifying Anti-fungal Agents

The invention further provides complexes of polypeptides useful, inter alia, in identifying agents that inhibit the growth of microorganisms such as fungi.

Human fungal infections have increased dramatically in incidence and severity in recent years. Advances in surgery and cancer treatments as well as the increasing use of broad-spectrum antimicrobials and the spread of HIV have increased the number of patients at risk for fungal infections. Most fungi are completely resistant to conventional antibacterial drugs.

The antifungal drugs presently available fall into several categories depending on their mode of action, as discussed below. Because several complexes according to the invention include proteins associated with these modes of action, the complexes can be used to identify anti-fungal agents.

Protein interactions which are useful for identifying anti-fungal agents are considered below.

(i) Interference in Nuclear Division

Griseofulvin interferes with nuclear division in fungal mitosis by disrupting the mitotic spindle and inhibiting cytoplasmic microtubule aggregation by interacting with polymerized microtubules. There is evidence that griseofulvin binds to a microtubule-associated protein in addition to binding to tubulin.

In accordance with the present invention, several interactions have presently been identified where one of the interacting partners is a microtubule or a microtubule-associated protein. Inhibiting any of these interactions could lead to the disruption of microtubules and interference in mitotic division, similar to the mode of action of griseofulvin, thereby providing a new means of inhibiting fungal activity. Accordingly, in some embodiments, the invention provides purified complexes of the proteins detailed in Table 4, below (interacting protein pairs are in bold, by row; a description of each protein follows).

TABLE 4

| Microtubule-related interactions identified | |
|---|---|
| APG7 | AUT7 |
| Apg12p-activating enzyme, involved in autophagy cytoplasm-to-vacuole protein targeting, and peroxisome degradation pathways | Forms a protein complex with Aut2p to mediate attachment of autophagosomes to microtubules. Aut7p has homology to LC3, a microtubule-associated protein from rat |
| DUO1 | BIM1 |
| Protein that interacts with Dam1p and causes cell death upon overproduction, involved in mitotic spindle function | Microtubule binding protein |
| BUB3 | MAD3 |
| Protein required for cell cycle arrest in response to loss of microtubule function | Checkpoint protein required for cell cycle arrest in response to loss of microtubule function |
| KAR4 | MUM2 |
| Regulatory protein required for pheromone induction of karyogamy genes, defective in nuclear fusion because of defect in microtubule-dependent movement of nuclei | Muddled Meiosis, mutant is sporulation defective and fails to perform premiotic DNA synthesis |
| CLN3 | MAD3 |
| G1/S-specific cyclin that interacts with Cdc28p protein kinase to control events at START | Checkpoint protein required for cell cycle arrest in response to loss of microtubule function |
| EBS1 | MAD2 |
| Protein with similarity to Est1p (Telomere elongation protein) | Spindle-assembly checkpoint protein |
| MSB2 | MAD2 |
| Protein for which overproduction suppresses bud emergence defect of cdc24 mutant, putative integral membrane protein | Spindle-assembly checkpoint protein |
| MSB2 | MAD3 |
| Protein for which overproduction suppresses bud emergence defect of cdc24 mutant, putative integral membrane protein | Checkpoint protein required for cell cycle arrest in response to loss of microtubule function |
| NUP157 | MAD2 |
| Nuclear pore protein (nucleoporin) | Spindle-assembly checkpoint protein |
| SAP4 | MAD2 |
| Sit4p-associated protein (SIT4 is a protein phosphatase) | Spindle-assembly checkpoint protein |
| SAP4 | MAD3 |
| Sit4p-associated protein (SIT4 is a protein phosphatase) | Checkpoint protein required for cell cycle arrest in response to loss of microtubule function |
| SIN4 | MAD2 |
| Component of RNA polymerase II holoenzyme/mediator complex, involved in positive and negative regulation of transcription, possibly via changes in chromatin structure | Spindle-assembly checkpoint protein |

TABLE 4-continued

Microtubule-related interactions identified

| | |
|---|---|
| SIN4 | MAD3 |
| Component of RNA polymerase II holoenzyme/mediator complex, involved in positive and negative regulation of transcription, possibly via changes in chromatin structure | Checkpoint protein required for cell cycle arrest in response to loss of microtubule function |
| YDR214W | MAD2 |
| Protein of unknown function | Spindle-assembly checkpoint protein |
| YNL218W | MAD2 |
| Protein with similarity to E coli DNA polymerase III gamma and tau subunits | Spindle-assembly checkpoint protein |
| MCM16 | MCM22 |
| Protein involved in chromosome segregation, plays a nonessential role that governs the kinetochore-microtubule mediated process of chromosome Segregation | Protein required for maintenance of chromosomes and minichromosomes |
| CYP2 | JSN1 |
| Cyclophilin (peptidylprolyl isomerase), ER or secreted isoform, plays a role in the stress response | Benomyl dependent tubulin mutant, Protein that when overexpressed can suppress the hyperstable microtubule phenotype of tub2-150 |
| SPC34 | JSN1 |
| Protein component of the spindle pole body | Benomyl dependent tubulin mutant, Protein that when overexpressed can suppress the hyperstable microtubule phenotype of tub2-150 |
| YIL065C | JSN1 |
| Protein of unknown function | Benomyl dependent tubulin mutant, Protein that when overexpressed can suppress the hyperstable microtubule phenotype of tub2-150 |
| YLR392C | JSN1 |
| Protein of unknown function | Benomyl dependent tubulin mutant, Protein that when overexpressed can suppress the hyperstable microtubule phenotype of tub2-150 |

As described above, in certain embodiments of these complexes contain the binding domains, of the polypeptides recited in Table 4, while other embodiments contain conservative variants of these polypeptides, or polypeptides which contain the polypeptides recited in Table 4.

(ii) Disruption of Ergosterol Biosynthesis

Azoles are synthetic compounds that can be classified as imidazoles (ketoconazole, clotrimazole and miconazole) or triazoles (itraconizole and fluconazole). The antifungal activity of azole drugs result from their reduction in the biosynthesis of ergosterol, the main sterol in the cell membranes of fungi. Reduction of ergosterol alters the structure of the cytoplasmic membrane as well as the function of several membrane-bound enzymes (such as those involved in nutrient transport and chitin synthesis). The azole drugs reduce ergosterol synthesis by inhibiting the fungal cytochrome p450 enzymes, specifically they inhibit the sterol 14-alpha-demethylase, a microsomal cytochrome P450-dependent enzyme system, leading to a decrease in ergosterol and an accumulation of 14-alpha-methylsterols. There is some evidence that the primary target of the azoles is the heme protein, which cocatalyzes cytochrome P-450-dependent 14-alpha-dependent 14-alpha-demethylation of lanosterol. One interaction containing a heme biosynthesis protein has been presently been identified (Table 5). Disruption of this interaction could also lead to depletion of ergosterol and accumulation of sterol precursors, including 14-alpha-methylated sterols, forming a membrane with altered structure and function. Accordingly, in some embodiments, the invention provides a purified complex of the proteins recited in Table 5, below.

TABLE 5

Heme biosynthesis protein interaction identified

| | |
|---|---|
| SED1 | HEM13 |
| Abundant cell surface glycoprotein that may contribute to cell wall integrity and stress resistance | Coproporphyrinogen III oxidase, oxygen-repressed, sixth step in heme biosynthetic pathway |

Complexes containing one or more variants of these polypeptides are within the scope of the present invention, as are polypeptides having amino acid sequences which include the polypeptides recited in Table 5.

(iii) Cell Wall Synthesis Inhibition

Fungi share many biochemical targets with other eukaryotic cells. However, the fungal cell wall is a unique organelle and contains compounds, such as mannan, chitin and glucans, that are unique to fungi. The cell wall is dynamic and essential to the viability of the fungi due to its roles in osmotic protection, transport of macromolecules, growth, conjugation and spore formation. Major disruption of the composition or organization of the cell wall deleteriously affects cell growth. A number of compounds have been discovered that inhibit the development of fungal cell walls. Two class of these antifungal drugs are echinocandins, which inhibit glucan synthesis, and nikkomycins, which inhibit chitin synthesis.

Several interactions between proteins localized to the cell wall or enzymes responsible for production of cell wall components have presently been identified. Inhibiting any of these interactions could lead to a disruption of the cell wall, hence providing new means for inhibiting fungal viability. Accordingly, in certain embodiments, the present invention provides purified complexes of the proteins detailed in Table 6, below.

TABLE 6

Cell wall-related protein interactions identified

| | |
|---|---|
| CDC11 | SPR28 |
| Septin, component of 10 nm filaments of mother-bud neck; involved in cytokinesis | Septin-related protein expressed during sporulation |
| YFR042W | KRE6 |
| Protein of unknown function | Glucan synthase subunit required for synthesis of beta-1,6-glucan, involved in cell wall beta-glucan assembly |
| YDR482C | SCW11 |
| Protein of unknown function | Soluble cell wall protein |
| SM11 | BAS1 |
| Protein involved in (1,3)-beta-glucan synthesis, possibly through regulation of cell wall glucan and chitin synthesis; Chromatin binding protein | Transcription factor regulating basal and induced activity of histidine and adenine biosynthesis genes |
| WSC3 | PEX14 |
| Protein required for maintenance of cell wall integrity and for the stress response | Peroxisomal peripheral membrane protein (peroxin) involved in import of peroxisomal matrix proteins |

Embodiments of these complexes containing the binding domains or conservative variants of these polypeptides are within the scope of the present invention, as are polypeptides which contain the polypeptides recited in Table 6.

Complexes Containing One or More Human Polypeptides

The invention also provides purified complexes of two or more human polypeptides. In some embodiments, the interacting polypeptides are human orthologs of the interacting yeast polypeptides. Human orthologs according to the invention are set out in Table 7, below.

Complexes of human ortholog binding domains, conservative variants, and polypeptides including the human orthologs recited in Table 7, are within the scope of the invention, as are labeled ortholog complexes and/or polypeptides.

TABLE 7

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| yal032c | Q13573 | SKIP | Nuclear protein Skip | ylr345w | p16118 | PFKFB1 | 6-phosphofructo-2-kinase/fructose-2,6-bisphosphatase/6PF-2-K/FRU-2,6-P2ase liver isozyme |
| yal032c | Q13573 | SKIP | Nuclear protein Skip | ylr423c | q02224 | CENPE | Centromeric protein E/CENP-E protein |
| yal032c | Q13573 | SKIP | Nuclear protein Skip | ypl151c | p35606 | COPP | Beta subunit of coatomer complex |
| yal034w-a | P06468 | TPM2 | Fibroblast muscle-type tropomyosin | ygl172w | p49790 | NUP153 | Nuclear pore complex protein NUP153. |
| yal034w-a | P07951 | TPM2 | Skeletal beta-tropomyosin | ygl172w | p35658 | NUP214 | Nuclear pore complex protein NUP214/CAN protein |
| yal034w-a | P35749 | MYH11 | Myosin heavy chain, smooth muscle isoform/SMMHC [FRAGMENT] | ygl172w | p52948 | NUP98 | Nuclear pore complex protein NUP98/Nucleoporin NUP 98 |
| yal034w-a | P49454 | CENPF | CENP-F kinetochore protein | ygl172w | p23490 | LOR | Loricrin |
| yal034w-a | Q15545 | TAF2F | Transcription initiation factor TFIID 55 kD subunit | ygl172w | p09651 | HNRPA1 | Heterogenous nuclear ribonucleoprotein A1/helix-destabilizing protein/single-strand binding protein/HNRNP core protein A1 |
| yal034w-a | P06468 | TPM2 | Fibroblast muscle-type tropomyosin | ygr120c | p49454 | CENPF | CENP-F kinetochore protein |
| yal034w-a | P07951 | TPM2 | Skeletal beta-tropomyosin | ygr120c | p30622 | RSN | Restin |
| yal034w-a | P49454 | CENPF | CENP-F kinetochore protein | ygr120c | p04114 | APOB | Apoiipoprotein B |
| yar003w | P78406 | MRNP41 | mRNA-associated protein mRNP 41 | ybr110w | o14727 | APAF1 | Apoptotic protease activating factor 1/APAF-1 |
| yar003w | Q05048 | CSTF1 | Cleavage stimulation factor, 50 kDa subunit | ybr175w | p35606 | COPP | Beta subunit of coatomer complex |
| yar003w | Q09028 | RBAP48 | Chromatin assembly factor 1 P48 subunit/retinoblastoma binding protein P48 | ybr175w | q15542 | TAF2D | Transcription initiation factor TFIID 100 Kd subunit/TAFII-100/TAFII100 |
| yar003w | Q15542 | TAF2D | Transcription initiation factor TFIID 100 Kd subunit/TAFII-100/TAFII100 | ybr175w | p04901 | GNB1 | Guanine nucleotide-binding protein G(I)/G(S)/G(T) beta subunit 1 |
| yar003w | Q16576 | RBBP7 | Histone acetyl transferase type B subunit 2/retinoblastoma-binding protein | ybr175w | p43034 | PAFAH1B1 | Platelet-activating factor acetyl-hydrolase B alpha subunit |
| yar014c | P19338 | NCL | Nucleolin/protein C23 | yer133w | p37140 | PPP1CB | Serine/threonine-protein phosphatase PP1-beta catalytic subunit |
| yar014c | P23327 | HRC | Sarcoplasmic reticulum histidine-rich calcium binding protein | yer133w | p08129 | PPP1CA | Serine/threonine protein phosphatase PP1-alpha 1 catalytic subunit |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| yar014c | P35663 | CYLC1 | Cyclin I | yer133w | p05323 | PPP2CA | Serine/threonine protein phosphatase PP2A-alpha, catalytic subunit |
| yar014c | P46100 | ATRX | Transcriptional regulator ATRX/X-linked helicase II/X-linked nuclear protein | yer133w | p11082 | PPP2CB | Serine/threonine protein phosphatase PP2A-beta, catalytic subunit |
| ybl101w-a | O15016 | KIAA0298 | Hypothetical protein KIAA0298 | ybl043w | q06481 | APLP2 | Amyloid-like protein 2/APPH/amyloid protein homolog |
| ybl101w-a | O15016 | KIAA0298 | Hypothetical protein KIAA0298 | yfl002w-a | q01484 | ANK2 | Ankyrin, brain variant 1/ankyrin B |
| ybl101w-a | O15016 | KIAA0298 | Hypothetical protein KIAA0298 | yjl162c | p31689 | HSJ2 | DNAJ protein homolog 2/HSJ-2 |
| ybl105c | P05127 | PRKCB | Protein kinase C-beta-2/PKC-beta-2 | yml109w | p46821 | MAP1B | Microtubule-associated protein 1B |
| ybl105c | P17252 | PRKCA | Protein kinase C alpha | yml109w | q14669 | TRIP12 | Thyroid receptor interacting protein 12/KIAA0045 |
| ybr006w | P30837 | ALDH5 | Mitochondrial aldehyde dehydrogenase X | ydr382w | p05387 | RPLP2 | 60S acidic ribosomal protein P2 |
| ybr006w | P00352 | ALDH1 | Aldehyde dehydrogenase, cytosolic/ALDH class 1/ALDHI/ALDH-E1 | ykl023w | p35579 | MYH9 | Myosin heavy chain, nonmuscle type A/cellular myosin heavy chain, type A/NMMHC-A |
| ybr006w | P05091 | ALDH2 | Aldehyde dehydrogenase, mitochondrial/class 2/ALDHI/ALDH-E2 | ykl023w | q08170 | SFRS4 | Pre-mRNA splicing factor SRp75 |
| ybr006w | P30837 | ALDH5 | Mitochondrial aldehyde dehydrogenase X | ykl023w | p35663 | CYLC1 | Cyclin I |
| ybr006w | P47895 | ALDH6 | Aldehyde dehydrogenase 6 | ykl023w | q14093 | CYLC2 | Cylicin II |
| ybr006w | P49189 | ALDH9 | Aldehyde dehydrogenase, E3 isozyme/gamma-aminobutyraldehyde dehydrogenase | ykl023w | q14203 | DCTN1 | Dynactin, 150 kD isoform [fragment] |
| ybr006w | P51649 | SSADH | Succinate sumialdehyde dehydrogenase/NAD+-dependent succinate-semi-aldehyde dehydrogenase | ykl023w | p35580 | MYH10 | Myosin heavy chain, nonmuscle type B/cellular myosin heavy chain, type B/NMMHC-B |
| ybr103w | O14727 | APAF1 | Apoptotic protease activating factor 1/APAF-1 | yil112w | p55273 | CDKN2D | Cyclin-dependent kinase 4 inhibitor D/P19INK4D |
| ybr103w | P43034 | PAFAH1B1 | Platelet-activating factor acetyl-hydrolase IB alpha subunit | yil112w | q01484 | ANK2 | Ankyrin, brain variant 1/ankyrin B |
| ybr103w | Q15269 | PWP2H | Periodic tryptophan protein 2 homolog | yil112w | q01485 | ANK2 | Brain ankyrin variant 2 |
| ybr103w | Q15542 | TAF2D | Transcription initiation factor TFIID 100 Kd subunit/TAFII-100/TAFII100 | yil112w | p20749 | BCL3 | B-cell lymphoma 3-encoded protein |
| ybr221c | P11177 | PDHB | Pyruvate dehydrogenase E1-beta subunit | ylr345w | q16875 | F26P | 6PF-2-K/FRU-2,6-P2ase brain/placenta-type isozyme/6-phosphofructo-2-kinase/fructose-2,6-bisphosphatase |
| ybr221c | P21953 | BCKDHB | 2-oxoisovalerate dehydrogenase beta subunit | ylr345w | p16118 | PFKFB1 | 6-phosphofructo-2-kinase/fructose-2,6-bisphosphatase/6PF-2-K/FRU-2,6-P2ase liver isozyme |
| ybr221c | P51854 | TKT2 | Transketolase 2 | ylr345w | q16877 | F263 | 6PF-2-K/FRU-2,6-P2ase testis-type isozyme/6-phosphofructo-2-kinase/fructose-2,6-bisphosphatasede |
| ybr244w | P07203 | GPX1 | Glutathione peroxidase | ylr117c | q14690 | KIAA0185 | RRP5 protein homolog/KIAA0185 [fragment] |
| ybr244w | P18283 | GPX2 | Glutathione peroxidase-GI. | ylr117c | q15431 | SYCP1 | Synaptonemal complex protein 1/SCP-1 protein |
| ybr270c | P30414 | NKTR | NK-tumor recognition protein/Natural-killer cells cyclophilin-related protein | yil105c | p20226 | TBP | TATA-binding protein/transcription initiation factor TFIID |
| ybr270c | P30414 | NKTR | NK-tumor recognition protein/Natural-killer cells cyclophilin-related protein | ykr026c | q14232 | ELF2B1 | Translation initiation factor eIF-2B alpha subunit |
| ybr270c | P30414 | NKTR | NK-tumor recognition protein/Natural-killer cells cyclophilin-related protein | ylr423c | q02224 | CENPE | Centromeric protein E/CENP-E protein |
| ybr270c | P30414 | NKTR | NK-tumor recognition protein/Natural-killer cells cyclophilin-related protein | Ymr236w | q16594 | TAF2G | Transcription initiation factor TFIID 31 kD subunit |
| ybr274w | P53355 | DAPK1 | Death-associated protein kinase 1/DAP-kinase 1 | ylr258w | p54840 | GYS2 | Glycogen synthase, liver |
| ybr274w | P54646 | PRKAA2 | 5'-AMP-activated protein kinase, catalytic alpha-2 chain | ylr258w | p13807 | GYS1 | Muscle glycogen synthase |
| ybr274w | P27448 | P78 | Putative serind/threonine-protein kinase P78 | Ymr255w | p46821 | MAP1B | Microtubule-associated protein 1B |
| ybr274w | P51812 | RPS6KA3 | Ribosomal protein S6 kinase II alpha 3/insulin-stimulated protein kinase 1 | Ymr255w | p29375 | RBBP2 | RBBP-2/retinoblastoma binding protein 2 |
| ybr274w | p53355 | DAPK1 | Death-associated protein kinase 1/DAP-kinase 1 | Ymr255w | q03111 | ENL | ENL protein |
| ybr274w | p54646 | PRKAA2 | 5'-AMP-activated protein kinase, catalytic alpha-2 chain | Ymr255w | p51825 | MLLT2 | AF-4 protein |
| ybr274w | q14012 | CAMK1 | Calcium/calmodulin-dependent protein kinase type I | Ymr255w | p11387 | TOP1 | Topoisomerase I |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| ybr274w | q15831 | STK11 | Serine/threonine-protein kinase 11 | Ymr255w | p46939 | UTRN | Utrophin |
| ycl020w | o15016 | KIAA0298 | Hypothetical protein KIAA0298 | yfl002w-a | q01484 | ANK2 | Ankyrin, brain variant 1/ankyrin B |
| ycl024w | p15735 | PHKG2 | Phosphorylase kinase, testis/liver, gamma-2 | ykr048c | q01105 | SET | Set protein/HLA-DR associated protein II/PHAPII |
| ycl024w | p27448 | P78 | Putative serind/threonine-protein kinase P78 | ykr048c | p46060 | RANGAP1 | RanGTPase activating protein 1 |
| ycl024w | p53355 | DAPK1 | Death-associated protein kinase 1/DAP-kinase 1 | ykr048c | q99457 | NAPIL3 | Nucleosome assembly protein 1-like3 |
| ycl024w | p54646 | PRKAA2 | 5'-AMP-activated protein kinase, catalytic alpha-2 chain | ykr048c | p55209 | NAP1L1 | NAP-1/nucleosome assembly protein 1-like 1 |
| ycl024w | q13131 | PRKAA1 | 5'-AMP-activated protein kinase, catalytic alpha-1 chain | ykr048c | o15355 | PPM1C | Protein phosphatase 2C gamma isoform/PP2C-GAMMA |
| ycl024w | q14012 | CAMK1 | Calcium/calmoduim-dependent protein kinase type I | ykr048c | q01534 | TSPY | Homo sapiens testicular protein (TSPY) mRNA, complete cds. |
| ycl024w | q15831 | STK11 | Serine/threonine-protein kinase 11 | ykr048c | p19338 | NCL | Nucleolin/protein C23 |
| ydl024w | q16566 | CAMK4 | calcium/calmodulin-dependent protein kinase IV | ykr048c | q99733 | NAP1L4 | Nucleosome assembly protein 2/nudeosome assembly protein 1-like 4 |
| ycl024w | q16816 | PHKG1 | Phosphorylase B kinase gamma catalytic chain, skeletal muscle isoform | ykr048c | p21817 | RYR1 | Ryanodine receptor 1 |
| ycl059c | p46821 | MAP1B | Microtubule-associated protein 1B | ygl201c | p49736 | MCM2 | DNA replication licensing factor MCM2/KIAA0030 |
| ydl063w | q05682 | CALD1 | Caldesmon/CDM | ylr423c | q02224 | CENPE | Centromeric protein E/CENP-E protein |
| ycr009c | p15924 | DSP | Desmoplakin I and II | ybr108w | p04280 | PRB1 | Salivary proline-rich protein/clone CP3, CP4, and CP5 |
| ycr009c | p49418 | AMPH | Amphiphysin | ybr108w | p54259 | DRPLA | Atrophin-1/dentatorubral-pallidoluysian atrophy protein |
| ydl006w | o15355 | PPM1C | Protein phosphatase 2C gamma isoform/PP2C-GAMMA | ydr162c | p46108 | CRK | Proto-oncogene C-CRK |
| ydl006w | p35813 | PPM1A | Protein phosphatase 2C alpha | ydr162c | p00519 | ABL1 | Proto-oncogene tyrosine-protein kinase ABL/c-abl |
| ydl006w | p49593 | KIAA0015 | Putative protein phosphatase 2C/PP2C/KIAA0015 | ydr162c | p51451 | BLK | Tyrosine-protein kinase BLK |
| ydl012c | p20226 | TBP | TATA-binding protein/transcription initiation factor TFIID | ydr151c | o15541 | ZNF183 | zinc finger protein 183 |
| ydl012c | p51531 | SMARCA2 | Possible global transcription activator SNF2L2/BRM | ydr151c | p26651 | ZFP36 | Tristetraproline/TTP/ZFP-36 |
| ydl012c | q10571 | MN1 | Probable tumor suppressor protein MN1 | ydr151c | p47974 | BRF2 | TIS11D protein/butyrate response factor 2/EGF-response factor 2 |
| ydl012c | q93074 | KIAA0192 | Hypothetical protein KIAA0192 | ydr151c | q07352 | BRF1 | Tis11B protein/butyrate response factor 1/EGF-response factor 1 |
| ydl012c | p51531 | SMARCA2 | Possible global transcription activator SNF2L2/BRM | yfr047c | q15274 | NADC | Nicotinate-nucleotide pyrophosphorylase [carboxylating]/quinolinate phosphoribosyl transferase |
| ydl012c | p20226 | TBP | TATA-binding protein/transcription initiation factor TFIID | yor355w | q14669 | TRIP12 | Thyroid receptor interacting protein 12/KIAA0045 |
| ydl012c | p51531 | SMARCA2 | Possible global transcription activator SNF2L2/BRM | yor355w | p42568 | MLLT3 | AF-9 protein |
| ydl013w | q07283 | THH | Trichohyalin | ydr510w | p55854 | SMT3H1 | Ubiquitin-like protein SMT3A |
| ydl013w | q07283 | THH | Trichohyalin | yer116c | p38398 | BRCA1 | BREAST CANCER, TYPE 1 |
| ydl017w | p24941 | CDK2 | Cell division protein kinase 2 | ycr050c | p49368 | CCT3 | T-complex protein 1, gamma subunit |
| ydl017w | p19784 | CSNK2A2 | Casein kinase II alpha' | ydl160c | p38919 | NUK-34 | Nuk__34 mRNA for translation initiation factor |
| ydl017w | p24941 | CDK2 | Cell division protein kinase 2 | ydl160c | q13838 | BAT1 | Probably ATP-dependent RNA helicase P47 |
| ydl017w | q00526 | CDK3 | Cell division protein kinase 3 | ydl160c | p04765 | EIF4A1 | Eukaryotic initiation factor 4AI |
| ydl017w | q00534 | CDK6 | Cell division protein kinase 6/PLSTIRE for serine/threonine protein kinase. | ydl160c | q14240 | EIF4A2 | Eukaryotic initiation factor 4AII |
| ydl017w | q00536 | PCTK1 | Serine/threonine protein kinase PCTAIRE-1 | ydl160c | p26196 | DDX6 | Probable ATP-dependent RNA helicase P54 |
| ydl017w | p24941 | CDK2 | Cell division protein kinase 2 | yjl088w | p00480 | OTC | Omithine carbamoylfransferase [precursor]/OTCase/ornithine transcarbamylase |
| ydl074c | p11055 | MYH3 | Embryonic myosin heavy chain. | ylr423c | q15431 | SYCP1 | Synaptonemal complex protein 1/SCP-1 protein |
| ydl074c | p12883 | MYH7 | Myosin heavy chain, cardiac muscle beta isoform | ylr423c | p12270 | TPR | Nucleoprotein TPR |
| ydl074c | p13533 | MYH6 | Myosin heavy chain, cardiac muscle alpha isoform | ylr423c | p30622 | RSN | Restin |
| ydl074c | p13535 | MYH8 | Myosin heavy chain, perinatal skeletal muscle | ylr423c | p05787 | KRT8 | Keratin, type II cytoskeletal 8/cytokeratin 8/K8/CK8 |
| ydl074c | p15924 | DSP | Desmoplakin I and II | ylr423c | p13535 | MYH8 | Myosin heavy chain, perinatal skeletal muscle |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| ydl074c | p35580 | MYH10 | Myosin heavy chain, nonmuscle type B/cellular myosin heavy chain, type B/NMMHC-B | ylr423c | p11047 | LAMC1 | Laminin gamma-1 chain [precursor]/aminin B2 chain |
| ydl074c | p49454 | CENPF | CENP-F kinetochore protein | ylr423c | p15924 | DSP | Desmoplakin I and II |
| ydl074c | q02224 | CENPE | Centromeric protein E/CENP-E protein | ylr423c | p49454 | CENPF | CENP-F kinetochore protein |
| ydl074c | q03001 | BPAG1 | Bullous 230 kDa pemphigoid antigen 1 | ylr423c | q02224 | CENPE | Centromeric protein E/CENP-E protein |
| ydl090c | p49356 | FNTB | farnesyl-protein transferase beta-subunit | ykl019w | p49354 | FNTA | Protein farnesyltransferase alpha-subunit |
| ydl090c | p53609 | PGGT1B | Geranylgeranyltransferase type I beta-subunit | ykl019w | q92696 | RABGGTA | RAB geranylgeranyl transferase alpha subunit |
| ydl097c | q13098 | GPS1 | G protein pathway suppressor 1 | yel009c | p05412 | JUN | Transcription factor AP-1/c-jun proto oncogene |
| ydl113c | p15924 | DSP | Desmoplakin I and II | yjl036w | p35580 | MYH10 | Myosin heavy chain, nonmuscle type B/cellular myosin heavy chain, type B/NMMHC-B |
| ydl113c | q02224 | CENPE | Centromeric protein E/CENP-E protein | yjl036w | p49454 | CENPF | CENP-F kinetochore protein |
| ydl113c | p15924 | DSP | Desmoplakin I and II | ylr423c | p49454 | CENPF | CENP-F kinetochore protein |
| ydl113c | q02224 | CENPE | Centromeric protein E/CENP-E protein | ylr423c | q02224 | CENPE | Centromeric protein E/CENP-E protein |
| ydl150w | p05423 | BN51T | BN51 protein | ykr025w | p39687 | PHAP1 | HLA-DR associated protein I |
| ydl150w | p06748 | NPM1 | Nucleophosmin | ykr025w | o15355 | PPM1C | Protein phosphatase 2C gamma isoform/PP2C-GAMMA |
| ydl150w | p35663 | CYLC1 | Cyclin I | ykr025w | p46100 | ATRX | Transcriptional regulator ATRX/X-linked helicase II/X-linked nuclear protein |
| ydl150w | p46100 | ATRX | Transcriptional regulator ATRX/X-linked helicase II/X-linked nuclear protein | ykr025w | p21815 | IBSP | Bone sialoprotein II [precursor]/BSPII/Cell-binding sialoprotein |
| ydl150w | p55081 | MFAP1 | Microfibrillar protein 1 | ykr025w | p19338 | NCL | Nucleolin/protein C23 |
| ydl150w | q14093 | CYLC2 | Cylicin II | ykr025w | p17480 | UBTF | Nucleolar transcription factor 1/upstream binding factor 1/UBF-1 |
| ydl154w | p20585 | MSH3 | DNA mismatch repair protein MSH3 | ygl025c | q02817 | MUC2 | Intestinal mucin 2/mucin 2 |
| ydl154w | p43246 | MSH2 | DNA mismatch repair protein MSH2 | ygl025c | q02078 | MEF2A | Myocyte-specific enhancer factor 2A |
| ydl154w | p20585 | MSH3 | DNA mismatch repair protein MSH3 | yil144w | p49454 | CENPF | CENP-F kinetochore protein |
| ydl154w | p43246 | MSH2 | DNA mismatch repair protein MSH2 | yil144w | q02224 | CENPE | Centromeric protein E/CENP-E protein |
| ydl154w | p52701 | MSH6 | DNA mismatch repair protein MSH6/G/T mismatch binding protein | yil144w | p15924 | DSP | Desmoplakin I and II |
| ydl154w | p43246 | MSH2 | DNA mismatch repair protein MSH2 | Ymr224c | p49959 | MRE11A | Double-strand break repair protein MRE11A/MRE11 homolog |
| ydl155w | p14635 | CCNB1 | G2/mitotic-specific cyclin B1 | ybr135w | p10275 | AR | Androgen receptor |
| ydl203c | q14154 | KIAA0141 | Hypothetical protein KIAA0141 | ygr058w | p28676 | GCA | Grancalcin |
| ydl203c | q14154 | KIAA0141 | Hypothetical protein KIAA0141 | yor372c | p54259 | DRPLA | Atrophin-1/dentatorubral-pallidoluysian atrophy protein |
| ydl239c | p12883 | MYH7 | Myosin heavy chain, cardiac muscle beta isoform | ylr423c | q15431 | SYCP1 | Synaptonemal complex protein 1/SCP-1 protein |
| ydl239c | p13533 | MYH6 | Myosin heavy chain, cardiac muscle alpha isoform | ylr423c | p12270 | TPR | Nucleoprotein TPR |
| ydl239c | p15924 | DSP | Desmoplakin I and II | ylr423c | p13535 | MYH8 | Myosin heavy chain, perinatal skeletal muscle |
| ydl239c | p30622 | RSN | Restin | ylr423c | p05787 | KRT8 | Keratin, type II cytoskeletal 8/cytokeratin 8/K8/CK8 |
| ydl239c | p35580 | MYH10 | Myosin heavy chain, nonmuscle type B/cellular myosin heavy chain, type B/NMMHC-B | ylr423c | p11047 | LAMC1 | Laminin gamma-1 chain [precursor]/aminin B2 chain |
| ydl239c | p49454 | CENPF | CENP-F kinetochore protein | ylr423c | p15924 | DSP | Desmoplakin I and II |
| ydl239c | q02224 | CENPE | Centromeric protein E/CENP-E protein | ylr423c | p49454 | CENPF | CENP-F kinetochore protein |
| ydl239c | q03001 | BPAG1 | Bullous 230 kDa pemphigoid antigen 1 | ylr423c | q02224 | CENPE | Centromeric protein E/CENP-E protein |
| ydl239c | q08378 | GOLGA3 | Golgin-160 | ylr423c | p30622 | RSN | Restin |
| ydl239c | p13533 | MYH6 | Myosin heavy chain, cardiac muscle alpha isoform | yol091w | q15431 | SYCP1 | Synaptonemal complex protein 1/SCP-1 protein |
| ydl239c | p15924 | DSP | Desmoplakin I and II | yol091w | p12270 | TPR | Nucleoprotein TPR |
| ydl239c | p49454 | CENPF | CENP-F kinetochore protein | yol091w | p42566 | EPS15 | Epidermal growth factor receptor substrate 15 |
| ydl239c | q02224 | CENPE | Centromeric protein E/CENP-E protein | yol091w | p49454 | CENPF | CENP-F kinetochore protein |
| ydl239c | q03001 | BPAG1 | Bullous 230 kDa pemphigoid antigen 1 | yol091w | q02224 | CENPE | Centromeric protein E/CENP-E protein |
| ydl239c | q08378 | GOLGA3 | Golgin-160 | yol091w | p35579 | MYH9 | Myosin heavy chain, nonmuscle type A/cellular myosin heavy chain, type A/NMMHC-A |
| ydl246c | p11766 | ADH5 | Class III alcohol dehydrogenase chi subunit | ydl246c | p11766 | ADH5 | Class III alcohol dehydrogenase chi subunit |
| ydl246c | q00796 | SORD | Sorbitol dehydrogenase/L-iditol-2 dehydrogenase | ydl246c | q00796 | SORD | Sorbitol dehydrogenase/L-iditol-2 dehydrogenase |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| ydl246c | p11766 | ADH5 | Class III alcohol dehydrogenase chi subunit | yjr159w | p11766 | ADH5 | Class III alcohol dehydrogenase chi subunit |
| ydl246c | q00796 | SORD | Sorbitol dehydrogenase/L-iditol-2 dehydrogenase | yjr159w | q00796 | SORD | Sorbitol dehydrogenase/L-iditol-2 dehydrogenase |
| ydr002w | p07197 | NEFM | Neurofilament triplet M protein/160 Kd neurofilament protein/NF-M | ykr048c | p21817 | RYR1 | Ryanodine receptor 1 |
| ydr002w | p12036 | NEFH | Neurofilament triplet H proprotein/200 Kd neurofilament protein | ykr048c | q01105 | SET | Set protein/HLA-DR associated protein II/PHAPII |
| ydr002w | p35663 | CYLC1 | Cyclin I | ykr048c | p55209 | NAP1L1 | NAP-1/nucleosome assembly protein 1-like 1 |
| ydr002w | p43487 | RANBP1 | RAN specific GTPase-activating protein/RanBP1 | ykr048c | p46060 | RANGAP1 | RanGTPase activating protein 1 |
| ydr002w | p46821 | MAP1B | Microtubule-associated protein 1B | ykr048c | q99457 | NAP1L3 | Nucleosome assembly protein 1-like3 |
| ydr002w | p49792 | RANBP2 | Nuclear pore complex protein NUP358/nucleoporin NUP358 | ykr048c | q99733 | NAP1L4 | Nucleosome assembly protein 2/nucleosome assembly protein 1-like 4 |
| ydr002w | q92794 | MOZ | Monocytic leukemia zinc finger protein | ykr048c | q01534 | TSPY | Homo sapiens testicular protein (TSPY) mRNA, complete cds. |
| ydr061w | p21439 | MDR3 | Membrane glycoprotein P | ycr086w | p39880 | CUTL1 | CCAAT displacement protein/CDP |
| ydr077w | q02817 | MUC2 | Intestinal mucin 2/mucin 2 | ydr044w | p36551 | CPO | Coproporphytinogen III oxidase/coprogen oxidase |
| ydr099w | p42655 | YWHAE | 14-3-3 protein epsilon | ybl043w | q06481 | APLP2 | Amyloid-like protein 2/APPH/amyloid protein homolog |
| ydr099w | p42655 | YWHAE | 14-3-3 protein epsilon | ynl042w | p54259 | DRPLA | Atrophin-1/dentatorubral-pallidoluysian atrophy protein |
| ydr128w | o00628 | PTS2R | Peroxisomal targeting signal 2 receptor | ylr208w | q09028 | RBAP48 | Chromatin assembly factor 1 P48 subunit/retinoblastoma binding protein P48 |
| ydr128w | p35606 | COPP | Beta subunit of coatomer complex | ylr208w | p25388 | GNB2-RS1 | Guanine nucleotide-binding protein beta subunit-like protein 12.3 |
| ydr128w | q09028 | RBAP48 | Chromatin assembly factor 1 P48 subunit/retinoblastoma binding protein P48 | ylr208w | q16576 | RBBP7 | Histone acetyl transferase type B subunit 2/retinoblastoma-binding protein |
| ydr128w | q16576 | RBBP7 | Histone acetyl transferase type B subunit 2/retinoblastoma-binding protein | ylr208w | p43034 | PAFAH1B1 | Platelet-activating factor acetyl-hydrolase IB alpha subunit |
| ydr142c | p25388 | GNB2-RS1 | Guanine nucleotide-binding protein beta subunit-like protein 12.3 | yil160c | p55084 | HADHB | Trifunctional enzyme beta subunit, mitochondrial [precursor] |
| ydr142c | q09028 | RBAP48 | Chromatin assembly factor 1 P48 subunit/retinoblastoma binding protein P48 | yil160c | p24752 | AMLAD | ALPHA-METHYLACETOACETIC-ACIDURIA |
| ydr142c | q13216 | CKN1 | Cockayne syndrome WD-repeat protein CSA | yil160c | p42765 | THIM | 3-ketoacyl-CoA thiolase mitochondrial/mitochondrial 3-oxoacyl-CoA thiolase |
| ydr142c | q13610 | PWP1 | Periodic tryptophan protein 1 homolog/keratinocyte protein IEF SSP 9502 | yil160c | p22307 | SCP2 | Nonspecific lipid-transfer protein/sterol carrier protein X/sterol carrier protein 2 |
| ydr142c | q16576 | RBBP7 | Histone acetyl transferase type B subunit 2/retinoblastoma-binding protein | yil160c | p09110 | ACAA | 3-ketoacyl-CoA thiolase, peroxisomal/3-oxoacyl-CoA peroxisomal thiolase. |
| ydr148c | p10515 | DLAT | Dihydrolipoamide acetyltransferase component of pyruvate dehydrogenase complex/PDC-E2 | ydr510w | q93068 | SMT3H3 | Ubiquitin-like protein SMT3C |
| ydr148c | p11182 | DBT | Lipoamide acyl transferase component of branched-chain alpha-keto acid dehydrogenase complex | ydr510w | p55855 | SMT3H2 | Ubiquitin-like protein SMT3B |
| ydr148c | p17677 | GAP43 | Neuromodulin/axonal membrane protein GAP-43 | ydr510w | p55854 | SMT3H1 | Ubiquitin-like protein SMT3A |
| ydr200c | p13533 | MYHB | Myosin heavy chain, cardiac muscle alpha isoform | Ymr052w | p30622 | RSN | Restin |
| ydr200c | p49454 | CENPF | CENP-F kinetochore protein | Ymr052w | p35580 | MYH10 | Myosin heavy chain, nonmuscle type B/cellular myosin heavy chain, type B/NMMHC-B |
| ydr200c | p49454 | CENPF | CENP-F kinetochore protein | ynl127w | p20309 | CHRM3 | Muscarinic acetylcholine receptor M3 |
| ydr201w | p12270 | TPR | Nucleoprotein TPR | yil144w | p49454 | CENPF | CENP-F kinetochore protein |
| ydr201w | p30622 | RSN | Restin | yil144w | q02224 | CENPE | Centromeric protein E/CENP-E protein |
| ydr218c | p43236 | PNUTL2 | Peanut-like protein 2/Brain protein H5 | yjr076c | q14141 | KIAA0128 | Septin 2 homolog [fragment] |
| ydr218c | q14141 | KIAA0128 | Septin 2 homolog [fragment] | yjr076c | q15019 | NEDD5 | NEDD5 protein homolog/KIAA0158 |
| ydr218c | q15019 | NEDD5 | NEDD5 protein homolog/KIAA0158 | yjr076c | q16643 | DBN1 | Drebin E |
| ydr218c | q16181 | CDC10 | CDC10 protein homolog | yjr076c | q16181 | CDC10 | CDC10 protein homolog |
| ydr225w | p02261 | H2AFA | Histone H2A.1 | ykr048c | p46060 | RANGAP1 | RanGTPase activating protein 1 |
| ydr225w | p04908 | none | Histone H2A.5 | ykr048c | q99457 | NAP1L3 | Nucleosome assembly protein 1-like3 |
| ydr225w | p16104 | H2AX | Histone H2A.X | ykr048c | q99733 | NAP1L4 | Nucleosome assembly protein 2/nucleosome assembly protein 1-like 4 |
| ydr225w | p28001 | H2AFO | Histone H2A.2/H2A/O | ykr048c | p55209 | NAP1L1 | NAP-1/nucleosome assembly protein 1-like 1 |
| ydr228c | p20226 | TBP | TATA-binding protein/transcription initiation factor TFIID | ylr423c | p49454 | CENPF | CENP-F kinetochore protein |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| ydr228c | p54252 | MJD1 | Machado-joseph disease protein 1 | ylr423c | q02224 | CENPE | Centromeric protein E/CENP-E protein |
| ydr228c | q10571 | MN1 | Probable tumor suppressor protein MN1 | ylr423c | p13535 | MYH8 | Myosin heavy chain, perinatal skeletal muscle |
| ydr228c | q93074 | KIAA0192 | Hypothetical protein KIAA0192 | ylr423c | p15924 | DSP | Desmoplakin I and II |
| ydr259c | p11055 | MYH3 | Embryonic myosin heavy chain. | ylr423c | p15924 | DSP | Desmoplakin I and II |
| ydr259c | p15924 | DSP | Desmoplakin I and II | ylr423c | p49454 | CENPF | CENP-F kinetochore protein |
| ydr259c | p49454 | CENPF | CENP-F kinetochore protein | ylr423c | q02224 | CENPE | Centromeric protein E/CENP-E protein |
| ydr308c | p24928 | POLR2A | DNA-directed RNA polymerase II largest subunit. | yor174w | p49321 | NASP | Nuclear autoantigenic sperm protein |
| ydr308c | q03001 | BPAG1 | Bullous 230 kDa pemphigoid antigen 1 | yor174w | p35580 | MYH10 | Myosin heavy chain, nonmuscle type B/ cellular myosin heavy chain, type B/ NMMHC-B |
| ydr311w | p32780 | BTF2 | Basic transcription factor 62 kD subunit | ygr120c | p04114 | APOB | Apolipoprotein B |
| ydr311w | p32780 | BTF2 | Basic transcription factor 62 kD subunit | ylr423c | q02224 | CENPE | Centromeric protein E/CENP-E protein |
| ydr328c | p07199 | CENP-B | Major centromere autoantigen B/ centromere protein B | yfl009w | p35606 | COPP | Beta subunit of coatomer complex |
| ydr328c | p17480 | UBTF | Nucleolar transcription factor 1/ upstream binding factor 1/UBF-1 | yfl009w | q15542 | TAF2D | Transcription initiation factor TFIID 100 Kd subunit/TAFII-100/TAFII100 |
| ydr328c | p19338 | NCL | Nucleolin/protein C23 | yfl009w | p04901 | GNB1 | Guanine nucleotide-binding protein G(I)/G(S)/G(T) beta subunit 1 |
| ydr328c | p34991 | TCEB1L | Cyclin A/CDK2-associated p19 | yfl009w | p43034 | PAFAH1B1 | Platelet-activating factoracetylhydrolase IB alpha subunit |
| ydr376w | p22570 | FDXR | NADPH:adrenodoxin oxidoreductase [precursor]/adrenodoxin reductase/ ferredosin-NADP+reductase | ycr093w | p54252 | MJD1 | Machado-joseph disease protein 1 |
| ydr376w | p22570 | FDXR | NADPH:adrenodoxin oxidoreductase [precursor]/adrenodoxin reductase/ ferredosin-NADP+reductase | ylr024c | p49321 | NASP | Nuclear autoantigenic sperm protein |
| ydr388w | p14317 | HCLS1 | Hematopoietic lineage cell specific protein | ycr009c | p15924 | DSP | Desmoplakin I and II |
| ydr388w | p49418 | AMPH | Amphiphysin | ycr009c | p49418 | AMPH | Amphiphysin |
| ydr394w | p17980 | PSMC3 | 26S protease regulatory subunit 6A/ TAT-binding protein 1/TBP-1 | ygr232w | q06547 | E4TF1B | GA binding protein beta-1 chain |
| ydr394w | p35998 | PSMC2 | 26S protease regulatory subunit 7/MSS1 protein | ygr232w | q01485 | ANK2 | Brain ankyrin variant 2 |
| ydr394w | p43686 | PSMC4 | 26S protease regulatory subunit 6B/ TAT-binding protein-7ITBP-7 | ygr232w | p53355 | DAPK1 | Death-associated protein kinase 1/DAP-kinase 1 |
| ydr394w | p47210 | PSMC5 | 26S proteasome regulatory subunit 8/ proteasome subunit p45 | ygr232w | p20749 | BCL3 | B-cell lymphoma 3-encoded protein |
| ydr394w | q03527 | PSMC1 | 26S protease (54) regulatory subunit | ygr232w | q01484 | ANK2 | Ankyrin, brain variant 1/ankyrin B |
| ydr394w | q92524 | PSMC6 | 26S protease regulatory subunit S10B/ proteasome subunit P42 | ygr232w | p42773 | CDN2C | Cyclin dependent kinase 6 inhibitor |
| ydr408c | p22102 | GART | Trifunctional purine biosynthetic protein adenosine-3 | ycr063w | p41223 | EDG2 | G10 protein homolog |
| ydr408c | p22102 | GART | Trifunctional purine biosynthetic protein adenosine-3 | yor174w | p35580 | MYH10 | Myosin heavy chain, nonmuscle type B/ cellular myosin heavy chain, type B/ NMMHC-B |
| ydr416w | q14690 | KIAA0185 | RRP5 protein homolog/KIAA0185 [fragment] | ygr129w | q02224 | CENPE | Centromeric protein E/CENP-E protein |
| ydr429c | p33240 | CSTF2 | Cleavage stimulation factor, 64 kD sub-unit | yfl017c | p08578 | SNRPE | Small nuclear ribonucleoprotein E/ snRNP-E |
| ydr439w | p13535 | MYH8 | Myosin heavy chain, perinatal skeletal muscle | ycr086w | p39880 | CUTL1 | CCAAT displacement protein/CDP |
| ydr477w | p54646 | PRKAA2 | 5'-AMP-activated protein kinase, catalytic alpha-2 chain | yer027c | p10451 | SPP1 | Osteopontin [precursor] |
| ydr482c | p42566 | EPS15 | Epidermal growth factor receptor substrate 15 | ygl028c | q02505 | MUC3 | Mucin 3 [fragments]/intestinal mucin 3 |
| ydr482c | q02224 | CENPE | Centromeric protein E/CENP-E protein | ygl028c | q02817 | MUC2 | Intestinal mucin 2/mucin 2 |
| ydr490c | p17612 | PRKACA | CAMP-dependent protein kinase catalytic subunit type alpha | ylr466w | q02505 | MUC3 | Mucin 3 [fragments]/intestinal mucin 3 |
| yer018c | p02546 | LMN1 | Lamin C | yhr193c | p50502 | HIP | Progesterone receptor-associated p48 protein |
| yer018c | p02545 | LMN1 | Lamin A/70 KD Lamin | Ymr117c | p30622 | RSN | Restin |
| yer018c | p02546 | LMN1 | Lamin C | Ymr117c | p49454 | CENPF | CENP-F kinetochore protein |
| yer018c | p35749 | MYH11 | Myosin heavy chain, smooth muscle isoform/SMMHC [FRAGMENT] | Ymr117c | p35580 | MYH10 | Myosin heavy chain, nonmuscle type B/ cellular myosin heavy chain, type B/ NMMHC-B |
| yer018c | q07283 | THH | Trichohyalin | Ymr117c | p11055 | MYH3 | Embryonic myosin heavy chain. |
| yer018c | q93074 | KIAA0192 | Hypothetical protein KIAA0192 | Ymr117c | p42566 | EPS15 | Epidermal growth factor receptor substrate 15 |
| yer023w | p32322 | PYCR1 | Pyrroline 5-carboxylate reductase | yer023w | p32322 | PYCR1 | Pyrroline 5-carboxylate reductase |
| yer082c | p11016 | GNB2 | Guanine nucleotide-binding protein beta subunit 2 | ykl142w | p07942 | LAMB1 | Laminin beta-1 chain/Laminin B1 chain |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| yer102w | p09058 | RPS8 | 40S ribosomal protein S8 | ybr135w | p10275 | AR | Androgen receptor |
| yer102w | p09058 | RPS8 | 40S ribosomal protein S8 | yfl017c | p08578 | SNRPE | Small nuclear ribonucleoprotein E/snRNP-E |
| yer106w | q13416 | ORC2L | Origin recognition complex subunit 2 | ycr086w | p39880 | CUTL1 | CCAAT displacement protein/CDP |
| yer127w | p30622 | RSN | Restin | ydr299w | p19338 | NCL | Nucleolin/protein C23 |
| yer127w | p35663 | CYLC1 | Cyclin I | ydr299w | p46060 | RANGAP1 | RanGTPase activating protein 1 |
| yer127w | p35749 | MYH11 | Myosin heavy chain, smooth muscle isoform/SMMHC [FRAGMENT] | ydr299w | p07197 | NEFM | Neurofilament triplet M protein/160 Kd neurofilament protein/NF-M |
| yer127w | p46100 | ATRX | Transcriptional regulator ATRX/X-linked helicase II/X-linked nuclear protein | ydr299w | p21817 | RYR1 | Ryanodine receptor 1 |
| yer127w | q01484 | ANK2 | Ankyrin, brain variant 1/ankyrin B | ydr299w | p46100 | ATRX | Transcriptional regulator ATRX/X-linked helicase II/X-linked nuclear protein |
| yer131w | q06722 | RPS26 | Ribosomal protein S26 | ylr435w | p27797 | CALR | Calreticulin/52kD ribonuclecprotein autoantigen RO/SS-A |
| yer133w | p05323 | PPP2CA | Serine/threonine protein phosphatase PP2A-alpha, catalytic subunit | ynl233w | p35251 | RFC1 | Replication factor C large subunit/activator 1140 Kd subunit |
| yer133w | p08129 | PPP1CA | Serine/threonine protein phosphatase PP1-alpha 1 catalytic subunit | ynl233w | p35663 | CYLC1 | Cyclin I |
| yer133w | p11082 | PPP2CB | Serine/threonine protein phosphatase PP2A-beta, catalytic subunit | ynl233w | p51825 | MLLT2 | AF-4 protein |
| yer133w | p36873 | PPP1CC | Serine/threonine-protein phosphatase PP1-gamma catalytic subunit | ynl233w | p46821 | MAP1B | Microtubule-associated protein 1B |
| yer133w | p37140 | PPP1CB | Serine/threonine-protein phosphatase PP1-beta catalytic subunit | ynl233w | p35659 | DEK | Dek protein |
| yer144c | o00507 | FAF-Y | Probable ubiquitin carboxyl-terminal hydrolase FAF-Y | ybr059c | q16816 | PHKG1 | Phosphorylase B kinase gamma catalytic chain, skeletal muscle isoform |
| yer144c | p45974 | USP5 | Ubiquitin carboxyl-terminal hydrolase 5/isopeptidase T | ybr059c | p51956 | NEK3 | Serine/threonine-protein kinase NEK3 [fragment] |
| yer144c | p51784 | USP11 | Ubiquitin C-terminal hydrolase 11 | ybr059c | p49137 | MAPKAPK-2 | Map kinase-activated protein kinase 2 |
| yer144c | p54578 | USP14 | Queuine tRNA-ribosyl transferase/tRNA-guanine transglycosylase | ybr059c | p51955 | NEK2 | Serine/threonine-protein kinase NEK2 |
| yer144c | q02817 | MUC2 | Intestinal mucin 2/mucin 2 | ybr059c | p15735 | PHKG2 | Phosphorylase kinase, testis/liver, gamma-2 |
| yer144c | q92995 | USP13 | Ubiquitin carboxyl-terminal hydrolase 13/isopeptidase T-3 | ybr059c | q13177 | PAK2 | Serine/threonine-protein kinase PAK-gamma |
| yer144c | q93008 | USP9X | Probable ubiquitin carboxyl-terminal hydrolase FAF-X | ybr059c | p27448 | P78 | Putative serind/threonine-protein kinase P78 |
| yer144c | q93009 | USP7 | Ubiquitin carboxyl-terminal hydrolase 7/herpesvirus associated ubiquitin-specific protease | ybr059c | p51957 | STK2 | Serine/threonine-protein kinase NRK2 |
| yer179w | q06609 | RAD51 | DNA repair protein RAD51 | yer179w | q06609 | RAD51 | DNA repair protein RAD51 |
| yer179w | q14565 | DMC1 | Meiotic recombination protein DMC1/LIM15 homolog | yer179w | q14565 | DMC1 | Meiotic recombination protein DMC1/LIM15 homolog |
| yfl010c | p02812 | PRB2 | Salivary proline-rich protein/Clone CP7 | ygr136w | p29354 | GRB2 | Growth factor receptor-bound protein 2 |
| yfl010c | p04280 | PRB1 | Salivary proline-rich protein/clone CP3, CP4, and CP5 | ygr136w | p06241 | FYN | Proto-oncogene tyrosine-protein kinase FYN/SYN |
| yfl010c | p10161 | PRB4 | Salivary proline-rich protein PO [fragment]/allele M | ygr136w | p14317 | HCLS1 | Hematopoietic lineage cell specific protein |
| yfl010c | p10162 | PRB4 | Salivary proline-rich protein PO [fragment]/allelle K | ygr136w | p19878 | NCF2 | Neutrophil cytosol factor 2/NCF-2/neutrophil NADPH oxidase factorde 2/P67-PHOX |
| yfl010c | p17600 | SYN1 | Synapsin l/brain protein 4.1 | ygr136w | q92794 | MOZ | Monocytic leukemia zinc finger protein |
| yfl010c | p22670 | RFX1 | MHC class regulatory factor RFX1 | ygr136w | q15811 | ITSN | Intersectin/SH3 domain-containing protein SH3P17 |
| yfl010c | p23246 | PSF | PTB-associated splicing factor | ygr136w | p16333 | NCK | Cytoplasmic protein NCK |
| yfl010c | p35637 | FUS | RNA-binding protein FUS/TLS | ygr136w | p46108 | CRK | Proto-oncogene C-CRK |
| yfl010c | q92793 | CREBBP | CREB-BINDING PROTEIN | ygr136w | p07947 | YES1 | Proto-oncogene tyrosine-protein kinase YES/C-YES |
| yfl010c | q92794 | MOZ | Monocytic leukemia zinc finger protein | ygr136w | p15498 | VAV | Vav proto-oncogene |
| yfl010c | q99217 | AIH1 | AMELOGENESIS IMPERFECTA 1, HYPOPLASTIC TYPE | ygr136w | p46109 | CRKL | Crk-like protein |
| yfl010c | p02812 | PRB2 | Salivary proline-rich protein/Clone CP7 | yor197w | p02812 | PRB2 | Salivary proline-rich protein/Clone CP7 |
| yfl010c | p04280 | PRB1 | Salivary proline-rich protein/clone CP3, CP4, and CP5 | yor197w | p04280 | PRB1 | Salivary proline-rich protein/clone CP3, CP4, and CP5 |
| yfl010c | p10161 | PRB4 | Salivary proline-rich protein PO [fragment]/allele M | yor197w | p54253 | SCA1 | Ataxin-1/Spinocerebellar ataxia type 1 protein |
| yfl010c | p22670 | RFX1 | MHC class II regulatory factor RFX1 | yor197w | q09472 | EP300 | E1A-associated protein P300 |
| yfl010c | p23246 | PSF | PTB-associated splicing factor | yor197w | q93074 | KIAA0192 | Hypothetical protein KIAA0192 |
| yfl010c | p35637 | FUS | RNA-binding protein FUS/TLS | yor197w | p42858 | HD | Huntingtin/huntington's disease protein |
| yfl010c | q99217 | AIH1 | AMELOGENESIS IMPERFECTA 1, HYPOPLASTIC TYPE | yor197w | q01844 | EWSR1 | RNA-binding protein EWS |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| yfl023w | q02224 | CENPE | Centromeric protein E/CENP-E protein | ybr154c | p19388 | POLR2E | DNA-directed RNA polymerase II 23 kD polypeptide/RPB25/XAP4 |
| yfl023w | p35580 | MYH10 | Myosin heavy chain, nonmuscle type B/ cellular myosin heavy chain, type B/ NMMHC-B | ylr200w | p49454 | CENPF | CENP-F kinetochore protein |
| yfl023w | p46100 | ATRX | Transcriptional regulator ATRX/X-linked helicase II/X-linked nuclear protein | ylr200w | q08379 | GOLGA2 | Golgin-95 |
| yfl023w | p48681 | NES | Nestin | ylr200w | p42566 | EPS15 | Epidermal growth factor receptor substrate 15 |
| yfl023w | q02224 | CENPE | Centromeric protein E/CENP-E protein | ylr200w | q02224 | CENPE | Centromeric protein E/CENP-E protein |
| yfr024c-a | p14317 | HCLS1 | Hematopoietic lineage cell specific protein | ybl007c | q99102 | MUC4 | Tracheo-bronchial mucin 4/mucin 4 [fragment] |
| yfr024c-a | p16333 | NCK | Cytoplasmic protein NCK | ybl007c | p16333 | NCK | Cytoplasmic protein NCK |
| yfr024c-a | p29354 | GRB2 | Growth factor receptor-bound protein 2 | ybl007c | p29354 | GRB2 | Growth factor receptor-bound protein 2 |
| yfr024c-a | p41240 | CSK | Tryrosine-protein kinase CSK | ybl007c | p06241 | FYN | Proto-oncogene tyrosine-protein kinase FYN/SYN |
| yfr024c-a | p46109 | CRKL | Crk-like protein | ybl007c | p09769 | M19722 | Human fgr proto-oncogene encoded p55-c-fgr protein complete cds. |
| yfr024c-a | p98171 | RGC1 | RHO-GAP hematopoietic protein C1 | ybl007c | q15811 | ITSN | Intersectin/SH3 domain-containing protein SH3P17 |
| yfr024c-a | q13813 | SPTA2 | Spectrin alpha chain, brain/nonerythroid alpha-spectrin | yb007c | p07947 | YES1 | Proto-oncogene tyrosine-protein kinase YES/C-YES |
| yfr024c-a | q15811 | ITSN | Intersectin/SH3 domain-containing protein SH3P17 | ybl007c | q14687 | KIAA0182 | Hypothetical protein KIAA0182 |
| yfr024c-a | p46109 | CRKL | Crk-like protein | ygr268c | q92794 | MOZ | Monocytic leukemia zinc finger protein |
| yfr047c | q15274 | NADC | Nicotinate-nucleotide pyro-phosphorylase [carboxylating]/quinolinate phosphoribosyl/transferase | yfr047c | q15274 | NADC | Nicotinate-nucleotide pyro-phosphorylase [carboxylating]/quinolinate phosphoribosyl transferase |
| ygl058w | p23567 | UBE2B | Ubiquitin-conjugating enzyme E2-17 kD | ycr066w | q00755 | PML | Probable transcription factor PML |
| ygl058w | p47986 | UBE2D3 | Ubiquitin-conjugating enzyme E2-17 kD 3 | ycr066w | p35227 | MEL18 | DNA-binding protein MEL-18/Zinc finger protein 144 |
| ygl058w | p49459 | UBE2A | Ubiquitin-conjugating enzyme E2-17 kD/HR6A | ycr066w | p15918 | RAG1 | V(D)J recombination activating protein 1 |
| ygl058w | p50550 | UBE2I | Ubiquitin conjugating enzyme E2-18 kD | ycr066w | o15541 | ZNF183 | zinc finger protein 183 |
| ygl058w | p51668 | UBE2D1 | Ubiquitin conjugating enzyme E2-17 kD | ycr066w | p35226 | BMI1 | DNA-binding protein BMI1 |
| ygl058w | p51669 | UBE2D2 | Ubiquitin conjugating enzyme E2-17 kD 2 | ycr066w | p38398 | BRCA1 | BREAST CANCER, TYPE 1 |
| ygl058w | p51965 | UBE2E1 | Ubiquitin conjugating enzyme E2-21 kD UBCH6 | ycr066w | p29591 | PML | Probable transcription factor PML |
| ygl058w | p56554 | UBE2G2 | Ubiquitin-conjugating enzyme E2 G2 | ycr066w | p29592 | PML | Probable transcription factor PML |
| ygl058w | q16781 | UBE2N | Ubiquitin conjugating enzyme E2-17 kD | ycr066w | p29590 | PML | Probable transcription factor PML |
| ygl058w | q99462 | UBE2G1 | Ubiquitin-conjugating enzyme E2 G1 | ycr066w | p29593 | PML | Probable transcription factor PML |
| ygl112c | p49848 | TAF2E | Transcription initiation factor TFIID 70 kD subunit/TAFII-70 | Ymr236w | q16594 | TAF2G | Transcription initiation factor TFIID 31 kD subunit |
| ygl112c | p49848 | TAF2E | Transcription initiation factor TFIID 70 kD subunit/TAFII-70 | Ymr255w | p51825 | MLLT2 | AF-4 protein |
| ygl115w | p54619 | PRKAG1 | 5'-AMP-activated protein kinase, gamma-1 subunit | yer027c | p10451 | SPP1 | Osteopontin [precursor] |
| ygl122c | p42858 | HD | Huntingtin/huntington's disease protein | ykr026c | q14232 | ELF2B1 | Translation initiation factor eIF-2B alpha subunit |
| ygl122c | q14814 | MEF2D | Myocyte-specific enhancer factor 2D | ykr026c | p49770 | EIF2B2 | Translation initiation factor EIF-2B beta subunit/S20iii15 |
| ygl150c | o14647 | CHD2 | Chromodomain-helicase-DNA-binding protein 2/CHD-2 | ydl002c | p17480 | UBTF | Nucleolar transcription factor 1/upstream binding factor |
| ygl150c | p19338 | NCL | Nucleolin/protein C23 | ydl002c | p36402 | TCF7 | T-cell-specific transcription factor 1/TCF-1 |
| ygl150c | p28370 | SMARCA1 | Possible global transcription activator SNF2L1 | ydl002c | q00059 | TCF6L1 | Mitochondrial transcription factor 1 |
| ygl150c | p46100 | ATRX | Transcriptional regulator ATRX/X-linked helicase II/X-linked nuclear protein | ydl002c | p26583 | HMG2 | High mobility group protein HMG2/HMG-2 |
| ygl150c | p51531 | SMARCA2 | Possible global transcription activator SNF2L2/BRM | ydl002c | q06945 | SOX4 | Transcription factor SOX-4 |
| ygl150c | p51532 | SMARCA4 | Possible global transcription activator SNF2L4/BRG-1 protein | ydl002c | q08945 | SSRP1 | Structure-specific recognition protein 1 |
| ygl150c | q03468 | CSB | Excision repair protein ERCC-6/cockayne syndrome protein CSB | ydl002c | p09429 | HMG1 | High mobility group-1 protein |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| ygl150c | p46100 | ATRX | Transcriptional regulator ATRX/X-linked helicase II/X-linked nuclear protein | yor355w | q14669 | TRIP12 | Thyroid receptor interacting protein 12/KIAA0045 |
| ygl150c | q03468 | CSB | Excision repair protein ERCC-6/cockayne syndrome protein CSB | yor355w | p42568 | MLLT3 | AF-9 protein |
| ygl155w | p49356 | FNTB | farnesyl-protein transferase beta-subunit | ykl019w | p49354 | FNTA | Protein farnesyltransferase alpha-subunit |
| ygl155w | p53609 | PGGT1B | Geranylgeranyltransferase type I beta-subunit | ykl019w | q92696 | RABGGTA | RAB geranylgeranyl transferase alpha subunit |
| ygl158w | p15735 | PHKG2 | Phosphorylase kinase, testis/liver, gamma-2 | ylr113w | p53779 | MAPK10 | Mitogen-activated protein kinase 10 |
| ygl158w | p27448 | P78 | Putative serind/threonine-protein kinase P78 | ylr113w | p53778 | MAPK12 | Mitogen-activated protein kinase 12/ERK6/extracellular signal-regulated kinase 6 |
| ygl158w | p49137 | MAPKAPK-2 | Map kinase-activated protein kinase 2 | ylr113w | p27361 | MAPK3 | Mitogen-activated protein kinase 3/extracellular signal-regulated kinase 1 |
| ygl158w | p51812 | RPS6KA3 | Ribosomal protein S6 kinase II alpha 3/insulin-stimulated protein kinase 1 | ylr113w | q15759 | MAPK11 | Mitogen-activated protein kinase 11 |
| ygl158w | p53355 | DAPK1 | Death-associated protein kinase 1/DAP-kinase 1 | ylr113w | p28482 | MAPK1 | Mitogen-activated protein kinase 1/extracellular signal-regulated kinase 2 |
| ygl158w | q14012 | CAMK1 | Calcium/calmodulin-dependent protein kinase type I | ylr113w | q16539 | MAPK14 | Mitogen-activated protein kinase 14/CSBP |
| ygl158w | q16566 | CAMK4 | calcium/calmodulin-dependent protein kinase IV | ylr113w | q13164 | MAPK7 | Mitogen-activated protein kinase 7/ERK5 |
| ygl158w | q16816 | PHKG1 | Phosphorylase B kinase gamma catalytic chain, skeletal muscle isoform | ylr113w | p45984 | MAPK9 | Mitogen activated protein kinase 9 |
| ygl189c | q06722 | RPS26 | Ribosomal protein S26 | ylr435w | p27797 | CALR | Calreticulin/52kD ribonucleoprotein autoantigen RO/SS-A |
| ygl192w | p04062 | GBA | Glucosylceramidase | ybr057c | p49454 | CENPF | CENP-F kinetochore protein |
| ygl237c | p23511 | NFYA | CAAT-box DNA binding protein subunit B | ybl021c | p25208 | NFYB | CCAAT-binding Transcription factor subunit A/CAAT-box DNA binding protein subunit B |
| ygl237c | p54259 | DRPLA | Atrophin-1/dentatorubral-pallidoluysian atrophy protein | ybl021c | q01658 | DR1 | TATA binding protein-associated phosphoprotein |
| ygl242c | p20749 | BCL3 | B-cell lymphoma 3-encoded protein | ykr099w | p10244 | MYBL2 | Myb-related protein B/B-myb |
| ygl242c | p53355 | DAPK1 | Death-associated protein kinase 1/DAP-kinase 1 | ykr099w | p10242 | MYB | MYB proto-oncogene protein |
| ygl242c | q01484 | ANK2 | Ankyrin, brain variant 1/ankyrin B | ykr099w | p25054 | APC | Adenomatous polyposis coli protein |
| ygl242c | q01485 | ANK2 | Brain ankyrin variant 2 | ykr099w | p10243 | MYBL1 | Myb-related protein A/A-myb |
| ygl254w | p08151 | GLI1 | GLI protein/zinc finger protein GLI1 | ygr047c | p19338 | NCL | Nucleolin/protein C23 |
| ygl254w | p41182 | BCL6 | B-cell lymphoma 6 protein/zinc finger protein 51 | ygr047c | p51531 | SMARCA2 | Possible global transcription activator SNF2L2/BRM |
| ygl254w | p41182 | BCL6 | B-cell lymphoma 6 protein/zinc finger protein 51 | yor039w | p13862 | CSNK2B | Casein kinase II beta subunit |
| ygr010w | q92764 | KRTHA5 | Keratin, type I cuticular HA5/hair keratin, type I HA5 | ygr010w | q92764 | KRTHA5 | Keratin, type 1 cuticular HA5/hair keratin, type I HA5 |
| ygr014w | p35658 | NUP214 | Nuclear pore complex protein NUP214/CAN protein | yil144w | p15924 | DSP | Desmoplakin I and II |
| ygr014w | q02817 | MUC2 | Intestinal mucin 2/mucin 2 | yil144w | q02224 | CENPE | Centromeric protein E/CENP-E protein |
| ygr014w | q14157 | KIAA0144 | Hypothetical protein KIAA0144 | yil144w | p13533 | MYH6 | Myosin heavy chain, cardiac muscle alpha isoform |
| ygr014w | q99102 | MUC4 | Tracheo-bronchial mucin 4/mucin 4 [fragment] | yil144w | p49454 | CENPF | CENP-F kinetochore protein |
| ygr017w | p17480 | UBTF | Nucleolar transcription factor 1/upstream binding factor 1/UBF-1 | ylr403w | q92785 | REQ | Zinc-finger protein UBI-D4/apoptosis response zinc finger protein requiem |
| ygr058w | p07384 | CAPN1 | Calpain 1, large [catalytic] subunit/calcium activated neutral proteinase | ygr058w | p07384 | CAPN1 | Calpain 1, large [catalytic] subunit/calcium activated neutral proteinase |
| ygr058w | p17655 | CAPN2 | Ca2-activated neutral proteinase/calpain 2, Large [catalytic] subunit | ygr058w | p17655 | CAPN2 | Ca2-activated neutral proteinase/calpain 2, Large [catalytic] subunit |
| ygr058w | p20807 | CAPN3 | Calpain P94, large [catalytic] subunit/CANP | ygr058w | p20807 | CAPN3 | Calpain P94, large [catalytic] subunit/CANP |
| ygr058w | p28676 | GCA | Grancalcin | ygr058w | p28676 | GCA | Grancalcin |
| ygr058w | p30626 | SR1 | Sorcin | ygr058w | p30626 | SRI | Sorcin |
| ygr058w | p07384 | CAPN1 | Calpain 1, large [catalytic] subunit/calcium activated neutral proteinase | ygr136w | p46108 | CRK | Proto-oncogene C-CRK |
| ygr058w | p17655 | CAPN2 | Ca2-activated neutral proteinase/calpain 2, Large [catalytic] subunit | ygr136w | p06241 | FYN | Proto-oncogene tyrosine-protein kinase FYN/SYN |
| ygr058w | p20807 | CAPN3 | Calpain P94, large [catalytic] subunit/CANP | ygr136w | p29354 | GRB2 | Growth factor receptor-bound protein 2 |
| ygr058w | p28676 | GCA | Grancalcin | ygr136w | p46109 | CRKL | Crk-like protein |
| ygr058w | p30626 | SRI | Sorcin | ygr136w | p14317 | HCLS1 | Hematopoietic lineage cell specific protein |
| ygr058w | p07384 | CAPN1 | Calpain 1, large [catalytic] subunit/calcium activated neutral proteinase | ylr113w | q13164 | MAPK7 | Mitogen-activated protein kinase 7/ERK5 |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| ygr058w | p17655 | CAPN2 | Ca2-activated neutral proteinase/calpain 2, Large [catalytic] subunit | ylr113w | p53778 | MAPK12 | Mitogen-activated protein kinase 12/ERK6/extracellular signal-regulated kinase 6 |
| ygr058w | p20807 | CAPN3 | Calpain P94, large [catalytic] subunit/CANP | ylr113w | p45984 | MAPK9 | Mitogen activated protein kinase 9 |
| ygr058w | p28676 | GCA | Grancalcin | ylr113w | p28482 | MAPK1 | Mitogen-activated protein kinase 1/extracellular signal-regulated kinase 2 |
| ygr058w | p30626 | SRI | Sorcin | ylr113w | p53779 | MAPK10 | Mitogen-activated protein kinase 10 |
| ygr058w | p07384 | CAPN1 | Calpain 1, large [catatytic] subunit/calcium activated neutral proteinase | ynl047c | q92636 | NSMAF | Protein fan/factor asociated with n-smase activation |
| ygr058w | p28676 | GCA | Grancalcin | ynl047c | q99418 | ARNO | ARF nucleotide-binding site opener/ARNO protein/ARF exchange factor |
| ygr108w | p14635 | CCNB1 | G2/mitotic-specific cyclin B1 | ybr135w | p10275 | AR | Androgen receptor |
| ygr119c | p23490 | LOR | Loricrin | ygl172w | p35658 | NUP214 | Nuclear pore complex protein NUP214/CAN protein |
| ygr119c | p35637 | FUS | RNA-binding protein FUS/TLS | ygl172w | p49790 | NUP153 | Nuclear pore complex protein NUP153. |
| ygr119c | p35658 | NUP214 | Nuclear pore complex protein NUP214/CAN protein | ygl172w | p09651 | HNRPA1 | Heterogenous nuclear ribonucleoprotein A1/helix-destabilizing protein/single-strand binding protein/HNRNP core protein A1 |
| ygr119c | p37198 | NUP62 | Nuclear pore glycoprotein P62 | ygl172w | p23490 | LOR | Loricrin |
| ygr119c | p49790 | NUP153 | Nuclear pore complex protein NUP153. | ygl172w | p52948 | NUP98 | Nuclear pore complex protein NUP98/Nucleoporin NUP 98 |
| ygr119c | p52948 | NUP98 | Nuclear pore complex protein NUP98/Nucleoporin NUP 98 | ygl172w | p13645 | KRT10 | Keratin, type I cytoskeletal 10 |
| ygr119c | p23490 | LOR | Loricrin | yjl041w | q14093 | CYLC2 | Cylicin II |
| ygr119c | p35637 | FUS | RNA-binding protein FUS/TLS | yjl041w | p35663 | CYLC1 | Cyclin I |
| ygr119c | p35658 | NUP214 | Nuclear pore complex protein NUP214/CAN protein | yjl041w | p35658 | NUP214 | Nuclear pore complex protein NUP214/CAN protein |
| ygr119c | p37198 | NUP62 | Nuclear pore glycoprotein P62 | yjl041w | p37198 | NUP62 | Nuclear pore glycoprotein P62 |
| ygr119c | p49790 | NUP153 | Nuclear pore complex protein NUP153. | yjl041w | p49790 | NUP153 | Nuclear pore complex protein NUP153. |
| ygr119c | p52948 | NUP98 | Nuclear pore complex protein NUP98/Nucleoporin NUP 98 | yjl041w | p52948 | NUP98 | Nuclear pore complex protein NUP98/Nucleoporin NUP 98 |
| ygr119c | p23490 | LOR | Loricrin | ylr423c | p15924 | DSP | Desmoplakin I and II |
| ygr119c | p35637 | FUS | RNA-binding protein FUS/TLS | ylr423c | p49454 | CENPF | CENP-F kinetochore protein |
| ygr119c | p35658 | NUP214 | Nuclear pore complex protein NUP214/CAN protein | ylr423c | p30622 | RSN | Restin |
| ygr119c | p37198 | NUP62 | Nuclear pore glycoprotein P62 | ylr423c | q02224 | CENPE | Centromeric protein E/CENP-E protein |
| ygr119c | p49790 | NUP153 | Nuclear pore complex protein NUP153. | ylr423c | p13535 | MYH8 | Myosin heavy chain, perinatal skeletal muscle |
| ygr119c | p52948 | NUP98 | Nuclear pore complex protein NUP98/Nucleoporin NUP 98 | ylr423c | p12270 | TPR | Nucleoprotein TPR |
| ygr119c | p37198 | NUP62 | Nuclear pore glycoprotein P62 | Ymr236w | q16594 | TAF2G | Transcription initiation factor TFIID 31 kD subunit |
| ygr144w | q16134 | ETFDH | Electron transfer flavoprotein-ubiquinone oxidereductase | ygr144w | q16134 | ETFDH | Electron transfer flavoprotein-ubiquinone oxidereductase |
| ygr155w | p35520 | CBS | Cystathionine beta-synthase | ycr086w | p39880 | CUTL1 | CCAAT displacement protein/CDP |
| ygr229c | p46100 | ATRX | Transcriptional regulator ATRX/X-linked helicase II/X-linked nuclear protein | ykr099w | p10243 | MYBL1 | Myb-related protein A/A-myb |
| ygr229c | p46821 | MAP1B | Microtubule-associated protein 1B | ykr099w | p25054 | APC | Adenomatous polyposis coli protein |
| ygr229c | q05682 | CALD1 | Caldesmon/CDM | ykr099w | p10242 | MYB | MYB proto-oncogene protein |
| ygr229c | q07283 | THH | Trichohyalin | ykr099w | p10244 | MYBL2 | Myb-related protein B/B-myb |
| ygr250c | p11940 | PABPL1 | PolyA binding protein 1 | yir001c | p26378 | ELAVL4 | Paraneoplastic encephalomyelitis antigen 3 |
| ygr250c | p26378 | ELAVL4 | Paraneoplastic encephalomyelitis antigen 3 | yir001c | q01844 | EWSR1 | RNA-binding protein EWS |
| ygr250c | p29558 | RBMS1 | Single-stranded DNA binding protein | yir001c | p35637 | FUS | RNA-binding protein FUS/TLS |
| ygr250c | p33240 | CSTF2 | Cleavage stimulation factor, 64 kD | yir001c | p33240 | CSTF2 | Cleavage stimulation factor, 64 kD subunit |
| ygr250c | p38159 | HNRPG | Heterogeneous nuclear ribonucleoprotein G/HNRNP G/glycoprotein P43 | yir001c | q01085 | TIAL1 | Nucleolysin TIAR |
| ygr250c | p98179 | RBM3 | Putative RNA binding protein 3 | yir001c | p11940 | PABPL1 | PolyA binding protein 1 |
| ygr250c | q01085 | TIAL1 | Nucleolysin TIAR | yir001c | p08621 | SNRP70 | U1 small nuclear ribonucleoprotein 70kD |
| ygr250c | q15427 | SAP49 | Spliceosome associated protein 49/SAP49 | yir001c | p98179 | RBM3 | Putative RNA binding protein 3 |
| ygr267c | p30793 | GCH1 | GTP cyclohydrolase | ygr267c | p30793 | GCH1 | GTP cyclohydrolase I |
| yhl004w | p08865 | LAMR1 | Colon carcinoma laminin-binding protein | ylr423c | q02224 | CENPE | Centromeric protein E/CENP-E protein |
| yhl018w | p80095 | PCBD | Pterin-4-alpha-carbinolamine dehydratase | yhl018w | p80095 | PCBD | PTERIN-4-ALPHA-CARBINOL-AMINE DEHYDRATASE |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| yhl019c | p20172 | CLAPM1 | Clathrin coat assembly protein AP50/KIAA0109 gene | ykl135c | p21851 | CLAPB1 | Beta adaptin |
| yhl019c | p53677 | P47B | Clathrin coat assembly protein AP47 homolog 2 | ykl135c | q10567 | ADTB1 | Beta-adaptin 1 |
| yhl027w | p08047 | SP1 | Transcription factor SP1 [fragment] | yjl056c | p52745 | ZNF36 | Zinc finger protein 36/zinc finger protein KOX18 |
| yhl027w | p08151 | GLI1 | GLI protein/zinc finger protein GLI1 | yjl056c | p52740 | ZNF132 | Zinc finger protein 132 |
| yhl027w | p10070 | GLI2 | Tax helper protein 2/zinc finger protein GLI2 | yjl056c | p52736 | ZNF133 | Zinc finger protein 133 |
| yhl027w | p10071 | GLI3 | Zinc finger protein GLI3 | yjl056c | p52742 | ZNF135 | Zinc finger protein 135 |
| yhl027w | p11161 | EGR2 | Early growth response protein 2/EGR-2 | yjl056c | q15072 | ZNF146 | Zinc finger protein OZF |
| yhl027w | p18146 | EGR1 | Early growth response protein 1 | yjl056c | q16600 | ZNF239 | Zinc finger protein 239/HOK-2 |
| yhl027w | p19544 | WT1 | Wilms' tumor protwin/WT33 | yjl056c | p17032 | ZNF37A | Zinc finger protein 37A [fragment] |
| yhl027w | p28160 | ZNF43 | Zinc finger protein 43/Zinnc protein HTF6 | yjl056c | q13360 | ZNF177 | Zinc finger protein 177 |
| yhl027w | q02446 | SP4 | Transcription factor SP4/SPR-1 | yjl056c | p51786 | ZNF157 | Zinc finger protein 157 |
| yhl027w | q05215 | EGR4 | Early growth response protein 4 | yjl056c | q06730 | ZNF33A | Zinc finger protein 33A/KIAA0065 |
| yhl027w | q06889 | EGR3 | Early growth response protein 3 | yjl056c | q05516 | ZNF145 | Zinc finger protein PLZF/zinc finger protein 145 |
| yhr016c | p06241 | FYN | Proto-oncogene tyrosine-protein kinase FYN/SYN | Ymr255w | q03111 | ENL | ENL protein |
| yhr016c | p14317 | HCLS1 | Hematopoietic lineage cell specific protein | Ymr255w | p29375 | RBBP2 | RBBP-2/retinoblastoma binding protein 2 |
| yhr016c | p16333 | NCK | Cytoplasmic protein NCK | Ymr255w | p11387 | TOP1 | Topoisomerase I |
| yhr016c | p29354 | GRB2 | Growth factor receptor-bound protein 2 | Ymr255w | p46821 | MAP1B | Microtubule-associated protein 1B |
| yhr016c | p41240 | CSK | Tryosine-protein kinase CSK | Ymr255w | p51825 | MLLT2 | AF-4 protein |
| yhr016c | q13813 | SPTA2 | Spectrin alpha chain, brain/nonerythroid alpha-spectrin | Ymr255w | o14647 | CHD2 | Chromodomain-helicase-DNA-binding priten 2/CHD-2 |
| yhr016c | q15811 | ITSN | Intersectin/SH3 domain-containing protein SH3P17 | Ymr255w | p46939 | UTRN | Utrophin |
| yhr039c | p30837 | ALDH5 | Mitochondrial aldehyde dehydrogenase X | ydr480w | p17931 | LGALS3 | Galectin-3/IgE-binding protein |
| yhr060w | p25789 | PSMA4 | Proteasome subunit C9 | ylr447c | q02547 | ATP6E | Vacuolar ATP synthase subunit AC39 |
| yhr084w | p24928 | POLR2A | DNA-directed RNA potymerase II largest subunit. | ydr480w | p17931 | LGALS3 | Galectin-3/IgE-binding protein |
| yhr108w | q03001 | BPAG1 | Bullous 230 kDa pemphigoid antigen 1 | ylr423c | q02224 | CENPE | Centromeric protein E/CENP-E protein |
| yhr111w | p22314 | UBE1 | Ubiquitin activating enzyme E1 | yhr111w | p22314 | UBE1 | Ubiquitin activating enzyme E1 |
| yhr111w | p41226 | UBE1L | Ubiquitin-activating enzyme E1 homolog | yhr111w | p41226 | UBE1L | Ubiquitin-activating enzyme E1 homolog |
| yhr114w | p07332 | FES | C-FES/proto-oncogene tyrosine-protein kinase FES/FPS | ylr423c | p49454 | CENPF | CENP-F kinetochore protein |
| yhr114w | p12270 | TPR | Nucleoprotein TPR | ylr423c | p05787 | KRT8 | Keratin, type II cytoskeletal 8/cytokeratin 8/K8/CK8 |
| yhr114w | p12883 | MYH7 | Myosin heavy chain, cardiac muscle beta isoform | ylr423c | p13535 | MYH8 | Myosin heavy chain, perinatal skeletal muscle |
| yhr114w | p14317 | HCLS1 | Hematopoietic lineage cell specific protein | ylr423c | p15924 | DSP | Desmoplakin I and II |
| yhr114w | p16333 | NCK | Cytoplasmic protein NCK | ylr423c | p30622 | RSN | Restin |
| yhr114w | p16591 | FER | Tyrosine kinase FER | ylr423c | q02224 | CENPE | Centromeric protein E/CENP-E protein |
| yhr114w | p98171 | RGC1 | RHO-GAP hematopoietic protein C1 | ylr423c | p12270 | TPR | Nucleoprotein TPR |
| yhr114w | q14247 | CTTN | SRC substrate cortactin/amplaxin | ylr423c | p11047 | LAMC1 | Laminin gamma-1 chain [precursor]/laminin B2 chain |
| yhr114w | q15811 | ITSN | Intersectin/SH3 domain-containing protein SH3P17 | ylr423c | q15431 | SYCP1 | Synaptonemal complex protein 1/SCP-1 protein |
| yhr143w-a | p53803 | POLR2K | DNA-directed RNA polymerases I, II, III 7.0 kD polypeptide | ylr423c | q02224 | CENPE | Centromeric protein E/CENP-E protein |
| yhr171w | p22314 | UBE1 | Ubiquitin activating enzyme E1 | ynr007c | p19338 | NCL | Nucleolin/protein C23 |
| yhr204w | p33908 | MA12 | Mannosyl-oligosaccharide alpha-1,2-mannosidase | ygl030w | p04645 | RPL30 | Ribosomal protein L30 |
| yil013c | p45844 | ABCG1 | White protein homolog | ydr174w | p09429 | HMG1 | High mobility group-1 protein |
| yil074c | p56545 | CTBP2 | C-terminal binding protein 2 | yer081w | p56545 | CTBP2 | C-terminal binding protein 2 |
| yil074c | q13363 | CTBP1 | C-terminal binding protein 1 | yer081w | q13363 | CTBP1 | C-terminal binding protein 1 |
| yil074c | p56545 | CTBP2 | C-terminal binding protein 2 | yil074c | p56545 | CTBP2 | C-terminal binding protein 2 |
| yil074c | q13363 | CTBP1 | C-terminal binding protein 1 | yil074c | q13363 | CTBP1 | C-terminal binding protein 1 |
| yil105c | p20226 | TBP | TATA-binding protein/transcription initiation factor TFIID | yer179w | q14565 | DMC1 | Meiotic recombination protein DMC1/LIM15 homolog |
| yil105c | q93074 | KIAA0192 | Hypothetical protein KIAA0192 | yer179w | q06609 | RAD51 | DNA repair protein RAD51 |
| yil105c | p20226 | TBP | TATA-binding protein/transcription initiation factor TFIID | ynl047c | q99418 | ARNO | ARF nucleotide-binding site opener/ARNO protein/ARF exchange factor |
| yil105c | q93074 | KIAA0192 | Hypothetical protein KIAA0192 | ynl047c | q92636 | NSMAF | Protein fan/factor associated with n-smase activation |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| yir005w | p33240 | CSTF2 | Cleavage stimulation factor, 64 kD subunit | ygl174w | p35663 | CYLC1 | Cyclin I |
| yjl036w | p08670 | VIM | Vimentin | ylr423c | p30622 | RSN | Restin |
| yjl036w | p12882 | MYSS | Myosin heavy chain skeletal muscle, light meromyosin region | ylr423c | p15924 | DSP | Desmoplakin I and II |
| yjl036w | p35580 | MYH10 | Myosin heavy chain, nonmuscle type B/ cellular myosin heavy chain, type B/ NMMHC-B | ylr423c | p49454 | CENPF | CENP-F kinetochore protein |
| yjl036w | p35749 | MYH11 | Myosin heavy chain, smooth muscle isoform/SMMHC [FRAGMENT] | ylr423c | p12270 | TPR | Nucleoprotein TPR |
| yjl036w | p48681 | NES | Nestin | ylr423c | p13535 | MYH8 | Myosin heavy chain, perinatal skeletal muscle |
| yjl036w | p49454 | CENPF | CENP-F kinetochore protein | ylr423c | q02224 | CENPE | Centromeric protein E/CENP-E protein |
| yjl036w | q15036 | KIAA0064 | Hypothetical protein KIAA0064 | ylr423c | q15431 | SYCP1 | Synaptonemal complex protein 1/SCP-1 protein |
| yjl092w | p35580 | MYH10 | Myosin heavy chain, nonmuscle type B/ cellular myosin heavy chain, type B/ NMMHC-B | ydr510w | p55854 | SMT3H1 | Ubiquitin-like protein SMT3A |
| yjl092w | p35580 | MYH10 | Myosin heavy chain, nonmuscle type B/ cellular myosin heavy chain, type B/ NMMHC-B | yor355w | p42568 | MLLT3 | AF-9 protein |
| yjl110c | p23769 | GATA2 | Endothelial transcription factor GATA-2 | ynl021w | q13547 | HDAC1 | Histone deacetylase 1/HD1 |
| yjl110c | p23771 | GATA3 | Trans-acting T-cell specific transcription factor GATA-3 | ynl021w | q92769 | HDAC2 | Histone deacetylase 2/HD2 |
| yjl110c | p43694 | GATA4 | Transcription factor GATA-4 | ynl021w | o15379 | DHAC3 | Histone deacetylase 3 |
| yjl110c | q92908 | GATA6 | Transcription factor GATA-6 | ynl021w | p56524 | KIAA0288 | Hypothetical protein KIAA0288 |
| yjl112w | p11016 | GNB2 | Guanine nucleotide-binding protein beta subunit 2 | yll001w | q05193 | DNM1 | Dynamin-1 |
| yjl112w | p43034 | PAFAH1B1 | Platelet-activating factor acetyl-hydrolase IB alpha subunit | yll001w | p20591 | MX1 | Interferon-regulated resistance GTP-binding protein MXA/interferon-induced protein P78 |
| yjl112w | q12788 | SAZD | WD-repeat protein SAZD | yll001w | p50570 | DNM2 | Dynamin-2 |
| yjl112w | q15542 | TAF2D | Transcription initiation factor TFIID 100 Kd subunit/TAFII-100/TAFII100 | yll001w | p20592 | MX2 | Interferon-regulated resistance GTP-binding protein MXB |
| yjl137c | p46976 | GYG | Glycogenin-1 | yjl137c | p46976 | GYG | Glycogenin-1 |
| ykl028w | p07199 | CENP-B | Major centromere autoantigen B/ centromere protein B | ydr311w | p32780 | BTF2 | Basic transcription factor 62kD subunit |
| ykl028w | p07199 | CENP-B | Major centromere autoantigen B/ centromere protein B | ykr062w | p29084 | GTF2E2 | Transcription factor IIE beta subunit |
| ykl067w | o00746 | NME4 | Nucleoside-diphosphate kinase | ykl067w | o00746 | NME4 | Nucleoside diphosphate kinase, mitochondrial |
| ykl067w | p15531 | NME1 | Nucleoside-diphosphate kinase A | ykl067w | p15531 | NME1 | Nucleoside diphosphate kinase A |
| ykl067w | p22392 | NME2 | Nucleoside diphosphate kinase B/NDP kinase B/nm23-H2 | ykl067w | p22392 | NME2 | Nucleoside diphosphate kinase B/NDP kinase B/nm23-H2 |
| ykl142w | p07942 | LAMB1 | Laminin beta-1 chain/Laminin B1 chain | ykl142w | p07942 | LAMB1 | Laminin beta-1 chain/Laminin B1 chain |
| ykl142w | p07942 | LAMB1 | Laminin beta-1 chain/Laminin B1 chain | Ymr165c | p51825 | MLLT2 | AF-4 protein |
| ykl166c | p14619 | PRKG1 | Type 1 beta cGMP-dependent protein kinase | yil033c | p10644 | PRKAR1A | cAMP-dependent protein kinase regulatory subunit type I-alpha |
| ykl166c | p17612 | PRKACA | cAMP-dependent protein kinase catalytic subunit type alpha | yil033c | q16281 | CNCG3 | CNG3/cyclic nucleotide-gated cation channel 3 [fragment] |
| ykl166c | p22694 | PRKACB | Testis-specific cAMP-dependent protein kinase catalytic subunit C-beta isoform | yil033c | q14028 | CNG4 | Cyclic-nucleotide-gated cation channel 4 |
| ykl166c | p23443 | RPS6KB1 | P70 ribosomal S6 kinase alpha-II | yil033c | p29973 | CNCG1 | cGMP-gated cation channel protein/ cyclic nucleotide gated channel, photoreceptor/cyclic-nucleotide-gated cation channel1/CNG channel 1/CNG1/CNG-1 |
| ykl166c | p24723 | PRKCH | Protein kinase C, ETA type/protein-kinase C-L | yil033c | p31321 | PRKAR1B | cAMP-dependent protein kinase regulatory subunit RI-beta |
| ykl166c | p31749 | AKT1 | RAC-alpha serine/threonine kinase | yil033c | p13861 | PRKAR2A | cAMP-dependent protein kinase type II-alpha regulatory chain |
| ykl166c | p31751 | AKT2 | RAC-beta serine/threonine kinase | yil033c | p31323 | PRKAR2B | cAMP-dependent protein kinase subunit RII-beta |
| ykl166c | p51812 | RPS6KA3 | Ribosomal protein 56 kinase II alpha 3/insulin-stimulated protein kinase 1 | yil033c | p14619 | PRKG1 | Type I beta cGMP-dependent protein kinase |
| ykr026c | p49770 | EIF2B2 | Translation initiation factor EIF-2B beta subunit/S20iii15 | ykr026c | p49770 | EIF2B2 | Translation initiation factor EIF-2B beta subunit/S20iii15 |
| ykr026c | q14232 | ELF2B1 | Translation initiation factor eIF-2B alpha subunit | ykr026c | q14232 | ELF2B1 | Translation initiation factor eIF-2B alpha subunit |
| ykr037c | p42566 | EPS15 | Epidermal growth factor receptor substrate 15 | ydr201w | p30622 | RSN | Restin |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| ykr083c | p09429 | HMG1 | High mobility group-1 protein | ykl052c | p19338 | NCL | Nucleolin/protein C23 |
| ykr083c | p17480 | UBTF | Nucleolar transcription factor 1/ upstream binding factor 1/UBF-1 | ykl052c | q92794 | MOZ | Monocytic leukemia zinc finger protein |
| yll046c | p33240 | CSTF2 | Cleavage stimulation factor, 64 kD subunit | yfr047c | q15274 | NADC | Nicotinate-nucleotide pyrophosphorylase [carboxylating]/ quinolinate phosphoribosyl transferase |
| ylr200w | p49454 | CENPF | CENP-F kinetochore protein | Ymr052c | p30622 | RSN | Restin |
| ylr200w | q02224 | CENPE | Centromeric protein E/CENP-E protein | Ymr052w | p35560 | MYH10 | Myosin heavy chain, nonmuscle type B/ cellulary myosin heavy chain, type B/ NMMHC-B |
| ylr216c | p05092 | CYPA | Peptidyl-prolyl cis-trans isomerase A/cyclophilin A | ylr037w | p36969 | GPX4 | Phospholpid hydroperoxide glutathione peroxidase/PHGPX |
| ylr216c | p23284 | PPIB | Peptidyl-proyl CIS-trans isomerase B [precursor]/cyclophilin B | ylr037w | p18283 | GPX2 | Glutathione peroxidase-GI. |
| ylr216c | p30405 | CYP3 | Peptidyl-prolyl CIS-Trans isomerase/ cyclophilin | ylr037w | p12079 | GPRP | Glutathione peroxidase-related protein 1 |
| ylr216c | p45877 | PPIC | Peptidyl-prolyl cis-trans isomerase C/ cyclophilin C | ylr037w | p22352 | GPX3 | Plasma glutathione peroxidase |
| ylr216c | q08752 | PPID | 40 kD peptidyl-prolyl CIS-TRANS isomerase/cyclophilin-40 mRNA, complete cds. | ylr037w | p07203 | GPX1 | Glutathione peroxidase |
| ylr229c | p21181 | CDC42 | G25K GTP-binding protein | ydl135c | p52565 | ARHGDIA | Rho GDP-dissociation inhibitor 1. |
| ylr229c | p25763 | CDC42 | GTP-binding protein G25K, placental isoform | ydl135c | p52566 | ARHGD1B | Rho GDP-dissociation inhibitor 2 |
| ylr245c | p32320 | CDA | Cytidine deaminase | ylr245c | p32320 | CDA | Cytidine deaminase - |
| ylr305c | p42336 | PIK3CA | Phosphatidylinositol 3-kinase catalytic subunit, alpha isoform | yor355w | q14669 | TRIP12 | Thyroid receptor interacting protein 12/ KIAA0045 |
| ylr305c | p42345 | FRAP | FKBP-rapamycin associated protein | yor355w | p42568 | MLLT3 | AF-9 protein |
| ylr423c | p15924 | DSP | Desmoplakin I and II | ygr120c | p30622 | RSN | Restin |
| ylr423c | p49454 | CENPF | CENP-F kinetochore protein | ygr120c | p49454 | CENPF | CENP-F kinetochore protein |
| ylr423c | q02224 | CENPE | Centromeric protein E/CENP-E protein | ygr120c | p04114 | APOB | Apolipoprotein B |
| ylr423c | p05787 | KRT8 | Keratin, type II cytoskeletal 8/ cytokeratin 8/K8/CK8 | ylr423c | p05787 | KRT8 | Keratin, type II cytoskeletal 8/ cytokeratin 8/K8/CK8 |
| ylr423c | p11047 | LAMC1 | Laminin gamma-1 chain [precursor]/ laminin B2 chain | ylr423c | p11047 | LAMC1 | Laminin gamma-1 chain [precursor]/ laminin B2 chain |
| ylr423c | p12270 | TPR | Nucleoprotein TPR | ylr423c | p12270 | TPR | Nucleoprotein TPR |
| ylr423c | p13535 | MYH8 | Myosin heavy chain, perinatal skeletal muscle | ylr423c | p13535 | MYH8 | Myosin heavy chain, perinatal skeletal muscle |
| ylr423c | p15924 | DSP | Desmoplakin I and II | ylr423c | p15924 | DSP | Desmoplakin I and II |
| ylr423c | p30622 | RSN | Restin | ylr423c | p30622 | RSN | Restin |
| ylr423c | p49454 | CENPF | CENP-F kinetochore protein | ylr423c | p49454 | CENPF | CENP-F kinetochore protein |
| ylr423c | q02224 | CENPE | Centromeric protein E/CENP-E protein | ylr423c | q02224 | CENPE | Centromeric protein E/CENP-E protein |
| ylr423c | q15431 | SYCP1 | Synaptonemal complex protein 1/SCP-1 protein | ylr423c | q15431 | SYCP1 | Synaptonemal complex protein 1/SCP-1 protein |
| ylr424w | p49454 | CENPF | CENP-F kinetochore protein | ykr022c | p19454 | CENPF | CENP-F kinetochore protein |
| ylr424w | p52756 | LUCA15 | Putative tumor suppressor LUCA15 | ykr022c | p13535 | MYH8 | Myosin heavy chain, perinatal skeletal muscle |
| ylr424w | p98175 | DXS8237E | DXS8237E protein | ykr022c | p35580 | MYH10 | Myosin heavy chain, nonmuscle type B/ cellulary myosin heavy chain, type B/ NMMHC-B |
| ylr429w | p31146 | CORO1 | Coronin-like Protein p57 | ydr328c | p07199 | CENP-B | Major centromere autoantigen B/ centromere protein B |
| ylr429w | p43034 | PAFAH1B1 | Platelet-activating factor acetyl-hydrolase IB alpha subunit | ydr328c | p34991 | TCEB1L | Cyclin A/CDK2-associated p19 |
| ylr429w | p46821 | MAP1B | Microtubule-associated protein 1B | ydr328c | p17480 | UBTF | Nucleolartranscription factor 1/ upstream binding factor 1/UBF-1 |
| ylr429w | q16576 | RBBP7 | Histone acetyl transferase type B subunit 2/retinoblastoma-binding protein | ydr328c | p19338 | NCL | Nucleolin/protein C23 |
| ylr432w | p12268 | IMPDH2 | Inosine monophosphate dehydrogenase 2 | ydr167w | q12962 | TAF2H | Transcription initiation factor TFIID 30 Kd subunit/TAFII-30/TAFII30 |
| ylr432w | p12268 | IMPDH2 | Inosine monophosphate dehydrogenase 2 | ykr026c | q14232 | ELF2B1 | Translation initiation factor eIF-2B alpha subunit |
| ylr432w | p20839 | IMPDH1 | Inosine-5'-monophosphate dehydrogenase 1/IMPDH-I/IMPD | ykr026c | p49770 | EIF2B2 | Translation initiation factor EIF-2B beta subunit/S20iii15 |
| ylr433c | p05323 | PPP2CA | Serine/threonine protein phosphatase PP2A-alpha, catalytic subunit | ynl047c | q99418 | ARNO | ARF nucleotide-binding site opener/ ARNO protein/ARF exchange factor |
| ylr433c | q08209 | PPP3CA | Serine/threonine protein phosphatase 2B catalytic subunit. Alpha isoform / calmodulin-dependent calcineurin A subunit, alpha subunit | ynl047c | q92636 | NSMAF | Protein fan/factor asociated with n-smase activation |
| ylr438w | p04181 | OAT | Ornithine aminotransferase | ygr010w | q92764 | KRTHA5 | Keratin, type I cuticular HA5/hair keratin, type I HA5 |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| ylr438w | p04181 | OAT | Ornithine aminotransferase | yhl025w | p20226 | TBP | TATA-binding protein/transcription initiation factor TFIID |
| yml015c | p52655 | GTF2A1 | Transcription initiation factor IIA alpha and beta chains/TFIIA-42 | ydr167w | q12962 | TAF2H | Transcription initiation factor TFIID 30 Kd subunit/TAFII-30/TAFII30 |
| yml015c | p52655 | GTF2A1 | Transcription initiation factor IIA alpha and beta chains/TFIIA-42 | ydr174w | p09429 | HMG1 | High mobility group-1 protein |
| yml015c | q15544 | TAF2I | Transcription initiation factor TFIID 28 kD subunit | ydr174w | p26583 | HMG2 | High mobility group protein HMG2/HMG-2 |
| yml088w | p46100 | ATRX | Transcriptional regulator ATRX/X-linked helicase II/X-linked nuclear protein | ydr328c | p07199 | CENP-B | Major centromere autoantigen B/centromere protein B |
| yml094w | p49454 | CENPF | CENP-F kinetochore protein | ylr200w | q02224 | CENPE | Centromeric protein E/CENP-E protein |
| yml094w | q99471 | MM-1 | C-myc binding protein MM-1 | ylr200w | p49454 | CENPF | CENP-F kinetochore protein |
| yml114c | q02832 | BLSA | B-lymphocyte antigen/B-lymphocyte surface antigen | ydr167w | q12962 | TAF2H | Transcription initiation factor TFIID 30 Kd subunit/TAFII-30/TAFII30 |
| ymr032w | p02533 | KRT14 | Keratin, type I cytoskeletal 14 | ylr423c | p49454 | CENPF | CENP-F kinetochore protein |
| ymr032w | p13533 | MYH6 | Myosin heavy chain, cardiac muscle alpha isoform | ylr423c | q02224 | CENPE | Centromeric protein E/CENP-E protein |
| ymr052w | p30622 | RSN | Restin | yfr008w | p12270 | TPR | Nucleoprotein TPR |
| ymr052w | p35580 | MYH10 | Myosin heavy chain, nonmuscle type B/cellular myosin heavy chain, type B/NMMHC-B | yfr008w | q02224 | CENPE | Centromeric protein E/CENP-E protein |
| ymr068w | p20749 | BCL3 | B-cell lymphoma 3-encoded protein | yil105c | q10571 | MN1 | Probable tumor suppressor protein MN1 |
| ymr068w | q01484 | ANK2 | Ankyrin, brain variant 1/ankyrin B | yil105c | p20226 | TBP | TATA-binding protein/transcription initiation factor TFIID |
| ymr068w | q01485 | ANK2 | Brain ankyrin variant 2 | yil105c | q93074 | KIAA0192 | Hypothetical protein KIAA0192 |
| ymr077c | p12270 | TPR | Nucleoprotein TPR | ykl052c | p19338 | NCL | Nucleolin/protein C23 |
| ymr077c | p35579 | MYH9 | Myosin heavy chain, nonmuscle type A/cellular myosin heavy chain, type A/NMMHC-A | ykl052c | q92794 | MOZ | Monocytic leukemia zinc finger protein |
| ymr091c | p07199 | CENP-B | Major centromere autoantigen B/centromere protein B | yfr037c | q15431 | SYCP1 | Synaptonemal complex protein 1/SCP-1 protein |
| ymr093w | o14727 | APAF1 | Apoptotic protease activating factor 1 APAF-1 | ydr398w | p17480 | UBTF | Nucleolin/transcription factor 1/upstream binding factor 1/UBF-1 |
| ymr093w | p25388 | GNB2-RS1 | Guanine nucleotide-binding protein beta subunit-like protein 12.3 | ydr398w | p07199 | CENP-B | Major centromere autoantigen B/centromere protein B |
| ymr093w | p35606 | COPP | Beta subunit of coatomer complex | ydr398w | p27824 | CANX | Calnexin/IP90 |
| ymr093w | q13610 | PWP1 | Periodic tryptophan protein 1 homolog/keratinocyte protein IEF SSP 9502 | ydr398w | p39687 | PHAP1 | HLA-DR associated protein |
| ymr093w | q15542 | TAF2D | Transcription initiation factor TFIID 100 kD subunit/TAFII-100/TAFII100 | ydr398w | q01105 | SET | Set protein/HLA-DR associated protein II/PHAPII |
| ymr102c | p25388 | GNB2-RS1 | Guanine nucleotide-binding protein beta subunit-like protein 12.3 | ynl218w | p35249 | RFC4 | Activator 137 kD subunit/repiication factor C, 37-kDa subunit |
| ymr102c | p43034 | PAFAH1B1 | Platelet-activating factor acetyl-hydrolase IB alpha subunit | ynl218w | p35250 | RFC2 | Activator 140 kD subunit/repiication factor C, 40 kDa subunit |
| ymr102c | p53621 | COPA | Coatomer alpha subunit | ynl218w | p40937 | RFC5 | Activator 1 36 kD subunit/replication factor C, 36-kDa subunit |
| ymr102c | q13610 | PWP1 | Periodic tryptophan protein 1 homolog/keratinocyte protein IEF SSP 9502 | ynl218w | p35251 | RFC1 | Replication factor C large subunit/activator 1140 Kd subunit |
| ymr210w | p08910 | PHS1-2 | PHS1-2 with ORF homologous to membrane receptor proteins | ykl142w | p07942 | LAMB1 | Laminin beta-1 chain/Laminin B1 chain |
| ymr212c | q14156 | KIAA0143 | Hypothetical protein KIAA0143 | ylr423c | q02224 | CENPE | Centromeric protein E/CENP-E protein |
| ymr255w | o14647 | CHD2 | Chromodomain-helicase-DNA-binding protein 2/CHD-2 | ygl122c | q92794 | MOZ | Monocytic leukemia zinc finger protein |
| ymr255w | p11387 | TOP1 | Topoisomerase I | ygl122c | q93074 | KIAA0192 | Hypothetical protein KIAA0192 |
| ymr255w | p29375 | RBBP2 | RBBP-2/retinoblastoma binding protein 2 | ygl122c | p20226 | TBP | TATA-binding protein/transcription initiation factor TFIID |
| ymr255w | p46821 | MAP1B | Microtubule-associated protein 1B | ygl122c | p51531 | SMARCA2 | Possible global transcription activator SNF2L2/BRM |
| ymr255w | p46939 | UTRN | Utrophin | ygl122c | q10571 | MN1 | Probable tumor suppressor protein MN1 |
| ymr255w | p51825 | MLLT2 | AF-4 protein | ygl122c | p42858 | HD | Huntingtin/huntington's disease protein |
| ymr255w | q03111 | ENL | ENL protein | ygl122c | q14814 | MEF2D | Myocyte-specific enhancer factor 2D |
| ymr267w | q15181 | PP | Inorganic pyrophosphatase [fragment]/Ppase | ykr026c | q14232 | ELF2B1 | Translation initiation factor eIF-2B alpha subunit |
| ymr269w | p35663 | CYLC1 | Cyclin | ykr026c | q14232 | ELF2B1 | Translation initiation factor eIF-2B alpha subunit |
| ymr269w | q14093 | CYLC2 | Cylicin II | ykr026c | p49770 | EIF2B2 | Translation initiation factor EIF-2B beta subunit/S20iii15 |
| ymr309c | p17480 | UBTF | Nucleolar transcription factor 1/upstream binding factor 1/UBF-1 | ynl047c | q92636 | NSMAF | Protein fan/factor asociated with n-smase activation |
| ymr309c | p35580 | MYH10 | Myosin heavy chain, nonmuscle type B/cellular myosin heavy chain, type B/NMMHC-B | ynl047c | q99418 | ARNO | ARF nucleotide-binding site opener/ARNO protein/ARF exchange factor |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| ymr309c | p35580 | MYH10 | Myosin heavy chain, nonmuscle type B/ cellular myosin heavy chain, type B/ NMMHC-B | ynl244c | p41567 | SUI1 | Protein translation factor SUI1 homolog/sui1iso1 |
| ynl023c | p35555 | FBN1 | Fibrillin 1 [precursor] | Ymr224c | p49959 | MRE11A | Double-strand break repair protein MRE11A/MRE11 homolog |
| ynl078w | p18583 | SON | Son protein/son3 | ykr048c | p55209 | NAP1L1 | NAP-1/nucleosome assembly protein 1-like 1 |
| ynl091w | q02832 | BLSA | B-lymphocyte antigen/B-lymphocyte surface antigen | ynl164c | q13190 | STX5A | Syntaxin 5 |
| ynl091w | p46821 | MAP1B | Microtubule-associated protein 1B | yor355w | q14669 | TRIP12 | Thyroid receptor interacting protein 12/KIAA0045 |
| ynl091w | q02832 | BLSA | B-lymphocyte antigen/B-lymphocyte surface antigen | yor355w | p42568 | MLLT3 | AF-9 protein |
| ynl091w | p23327 | HRC | Sarcoplasmic reticulum histidine-rich calcium binding protein | yp1229w | p20265 | POU3F2 | Nervous-system specific octamer-binding transcription factor N-Oct 3/N-Oct 5a/N-Oct 5b |
| ynl091w | p35579 | MYH9 | Myosin heavy chain, nonmuscle type A/ cellular myosin heavy chain, type A/ NMMHC-A | yp1229w | p51531 | SMARCA2 | Possible global transcription activator SNF2L2/BRM |
| ynl091w | p35749 | MYH11 | Myosin heavy chain, smooth muscle isoform/SMMHC [FRAGMENT] | yp1229w | q93074 | KIAA0192 | Hypothetica protein KIAA0192 |
| ynl091w | p45379 | TNNT2 | Troponin T, cardiacmuscle isoforms | yp1229w | q01826 | SATB1 | DNA binding protein SATB1 |
| ynl091w | p46100 | ATRX | Transcriptional regulator ATRX/X-linked helicase II/X-linked nuclear protein | yp1229w | p54252 | MJD1 | Machado-joseph disease protein 1 |
| ynl091w | p46821 | MAP1B | Microtubule-associated protein 1B | yp1229w | p42858 | HD | Huntingtin/huntington's disease protein |
| ynl091w | q02832 | BLSA | B-ymphocyte antigen/B-lymphocyte surface antigen | yp1229w | p10275 | AR | Androgen receptor |
| ynl091w | q05682 | CALD1 | Caldesmon/CDM | yp1229w | q10571 | MN1 | Probable tumor suppressor protein MN1 |
| ynl091w | q07283 | THH | Trichohyalin | yp1220w | p20226 | TBP | TATA-binding protein/transcription initiation factor TFIID |
| ynl091w | q15696 | U2AF1-RS2 | U2 small nuclear ribonucleoprotein auxiliary factor 35 kD subunit related-protein 2 | yp1229w | p54253 | SCA1 | Ataxin-1/Spinocerebellar ataxia type 1 protein |
| ynl127w | p20309 | CHRM3 | Muscarinic acetylcholine receptor M3 | yal016w | p30153 | PPP2R1A | Protein phosphatase PP2A, 65Kd regulator subunit alpha-isotype |
| ynl127w | p20309 | CHRM3 | Muscarinic acetylcholine receptor M3 | ykr055w | p21181 | CDC42 | G25K GTP-binding protein |
| ynl154c | p48729 | CSNK1A1 | Casein kinase I, alpha isoform/CK1-alpha/CK1 | ycl054w | q05682 | CALD1 | Caldesmon/CDM |
| ynl154c | p48730 | CSNK1D | Casein kinase I delta isoform | ycl054w | p35663 | CYLC1 | Cyclin I |
| ynl154c | p49674 | CSNK1E | Casein kinase I epsilon | ycl054w | p12883 | MYH7 | MYOSIN, CARDIAC, HEAVY CHAIN, BETA |
| ynl154c | p51812 | RPS6KA3 | Ribosomal protein S6 kinase II alpha 3/insulin-stimulated protein kinase 1 | ycl054w | p19338 | NCL | Nucleolin/protein C23 |
| ynl154c | p78368 | CSNK1G2 | Casein kinase I, gamma 2 isoform | ycl054w | p35579 | MYH9 | Myosin heavy chain, nonmuscle type A/ cellular myosin heavy chain, type A/ NMMHC-A |
| ynl154c | p48730 | CSNK1D | Casein kinase I delta isoform | ycr011c | p45844 | ABCG1 | White protein homolog |
| ynl154c | p48729 | CSNK1A1 | Casein kinase I, alpha isoform/CK1-alpha/CK1 | ykl204w | p10163 | PRB4 | PROLINE-RICH PROTEIN, BstNI SUBFAMILY, 4 |
| ynl154c | p48730 | CSNK1D | Casein kinase I delta isoform | ykl204w | p48634 | BAT2 | Large proline-rich protein BAT2/ HLA-B-associated transcript 2 |
| ynl154c | p49674 | CSNK1E | Casein kinase I epsilon | ykl204w | p54259 | DRPLA | Atrophin-1/dentatorubral-pallidoluysian atrophy protein |
| ynl154c | p51812 | RPS6KA3 | Ribosomal protein S6 kinase II alpha 3/insulin-stimulated protein kinase 1 | ykl204w | p04280 | PRB1 | Salivary proline-rich protein/clone CP3, CP4, and CP5 |
| ynl154c | p78368 | CSNK1G2 | Casein kinase I, gamma 2 isoform | ykl204w | p02812 | PRB2 | Salivary proline-rich protein/Clone CP7 |
| ynl154c | p48730 | CSNK1D | Casein kinase I delta isoform | Ymr267w | q15181 | PP | Inorganic pyrophosphatase [fragment]/ Ppase |
| ynl154c | p48730 | CSNK1D | Casein kinase I delta isoform | yor355w | p42568 | MLLT3 | AF-9 protein |
| ynl154c | p49674 | CSNK1E | Casein kinase I epsilon | yor355w | q14669 | TRIP12 | Thyroid receptor interacting protein 12/ KIAA0045 |
| ynl189w | p35222 | CTNNB1 | Beta-catenin. | ybr252w | p33316 | DUT | Deoxyuridine triphosphatase nucleotidohydrolase |
| ynl180w | p52294 | KPNA1 | Importin alpha-1 subunit/SRP1-beta/ nucleoprotein interactor 1 | ybr252w | p10265 | PRT | Retrovirus-related protease |
| ynl180w | o00505 | KPNA3 | Karyopherin alpha 3 | yhl009c | p17861 | XBP1 | X box binding protein-1/XBP-1 |
| ynl180w | o00629 | QIP1 | Karyopherin alpha 4/Qip1 | yhl009c | q15431 | SYCP1 | Synaptonemal complex protein 1/SCP-1 protein |
| ynl180w | p35222 | CTNNB1 | Beta-catenin. | yhl009c | p25054 | APC | Adenomatous polyposis coli protein |
| ynl189w | p52292 | KPNA2 | Importin alpha-2 subunit/SRP1-alpha | yhl009c | p12270 | TPR | Nucleoprotein TPR |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| ynl189w | p52294 | KPNA1 | Importin alpha-1 subunit/SRP1-beta/nucleoprotein interactor 1 | yhl009c | q02224 | CENPE | Centromeric protein E/CENP-E protein |
| ynl189w | p35222 | CTNNB1 | Beta-catenin. | yjr159w | p11766 | ADH5 | Class III alcohol dehydrogenase chi subunit |
| ynl189w | p52294 | KPNA1 | Importin alpha-1 subunit/SRP1-beta/nucleoprotein interactor 1 | yjr159w | q00796 | SORD | Sorbitol dehydrogenase/L-iditol-2 dehydrogenase |
| ynl189w | p35222 | CTNNB1 | Beta-catenin. | ylr303w | p32929 | CTH | Cystathionine gamma-lyase |
| ynl189w | o00505 | KPNA3 | Karyopherin alpha 3 | yml020w | p32119 | TDPX1 | Thioredoxin peroxidase 1/thioredoxin-dependent peroxide reductase 1/thiol-specific antioxidant protein/TSA/PRP/natural killer cell enhancing factor B/NKEF-B |
| ynl189w | o00629 | QIP1 | Karyopherin alpha 4/Qip1 | yml020w | q13162 | AOE372 | Thioredoxin peroxidase AO372/antioxidant enzyme AOE372 |
| ynl189w | p35222 | CTNNB1 | Beta-catenin. | yml028w | q06830 | TDPX2 | Thioredoxin peroxidase 2/proliferation-associated gene (pag). |
| ynl189w | p52292 | KPNA2 | Importin alpha-2 subunit/SRP1-alpha | yml020w | p30041 | AOP2 | Antioxidant protein 2 |
| ynl189w | p52294 | KPNA1 | Importin alpha-1 subunit/SRP1-beta/nucleoprotein interactor 1 | yml020w | p30048 | AOP1 | Mitochondrial thioredoxin-dependent peroxide reductase/antioxidant protein 1 |
| ynl189w | o00505 | KPNA3 | Karyopherin alpha 3 | Ymr226c | p15428 | PGDH1 | 15-Hydroxyprostaglandin dehydrogenase [NAD(+)]/PGDH |
| ynl189w | p35222 | CTNNB1 | Beta-catenin. | Ymr226c | q02338 | BDH | D-beta-hydroxybutyrate dehydrogenase/3-hydroxybutyrate dehydrogenase |
| ynl189w | p52292 | KPNA2 | Importin alpha-2 subunit/SRP1-alpha | Ymr226c | q92781 | RDH1 | 11-cis retinol dehydrogenase |
| ynl189w | p52294 | KPNA1 | Importin alpha-1 subunit/SRP1-beta/nucleoprotein interactor 1 | Ymr226c | p14061 | E2DH | Estradiol 17 beta-dehydrogenase 1/17-beta-HSD 1 |
| ynl189w | p35222 | CTNNB1 | Beta-catenin. | yol058w | p00966 | ASS | Argininosuccinate synthase/citrulline-aspartate ligase |
| ynl189w | p35222 | CTNNB1 | Beta-catenin. | ypl111w | p78540 | ARG2 | Arginase II/non-hepatic arginase |
| ynl189w | p52294 | KPNA1 | Importin alpha-1 subunit/SRP1-beta/nucleoprotein interactor 1 | ypl111w | p05089 | ARG1 | Arginase 1 |
| ynl218w | q00341 | HBP | High density lipoprotein binding protein | ykl142w | p07942 | LAMB1 | Laminin beta-1 chain/Laminin B1 chain |
| ynl218w | p35249 | RFC4 | Activator 137 kD subunit/replication factor C, 37-kDa subunit | ylr423c | p49454 | CENPF | CENP-F kinetochore protein |
| ynl218w | p35250 | RFC2 | Activator 140 kD subunit/replication factor C, 40 kDa subunit | ylr423c | p15924 | DSP | Desmoplakin I and II |
| ynl218w | p35251 | RFC1 | Replication factor C large subunit/activator 1140 Kd subunit | ylr423c | p13535 | MYH8 | Myosin heavy chain, perinatal skeletal muscle |
| ynl218w | p40937 | RFC5 | Activator 136 kD subunit/replication factor C, 36-kDa subunit | ylr423c | q02224 | CENPE | Centromeric protein E/CENP-E protein |
| ynl218w | p35249 | RFC4 | Activator 137 kD subunit/replication factor C, 37-kDa subunit | ynl218w | p35249 | RFC4 | Activator 137 kD subunit/replication factor C, 37-kDa subunit |
| ynl218w | p35250 | RFC2 | Activator 140 kD subunit/replication factor C, 40 kDa subunit | ynl218w | p35250 | RFC2 | Activator 140 kD subunit/replication factor C, 40 kDa subunit |
| ynl218w | p35251 | RFC1 | Replication factor C large subunit/activator 1140 Kd subunit | ynl218w | p35251 | RFC1 | Replication factor C large subunit/activator 1140 Kd subunit |
| ynl218w | p40937 | RFC5 | Activator 136 kD subunit/replication factor C, 36-kDa subunit | ynl218w | p40937 | RFCS | Activator 1136 kD subunit/replication factor C, 36-kDa subunit |
| ynl287w | p21851 | CLAPB1 | Beta adaptin | ybr281c | p31146 | CORO1 | Coroninlike Protein P57 |
| ynl287w | q10567 | ADTB1 | Beta-adaptin 1 | ybr281c | p35606 | COPP | Beta subunit of coatomer complex |
| ynr006w | p12036 | NEFH | Neurofilament triplet H proprotein/200 Kd neurofilament protein | yhl002w | q15811 | ITSN | Intersectin/SH3 domain-containing protein protein SH3P17 |
| ynr006w | p26358 | DNMT | DNA/cytosine-5)0methyl transferase/DNA methyltransferase/DNA metase/MCMT/M.HSAI | yhl002w | q14247 | CTTN | SRC substrate cortactin/amplaxin |
| ynr006w | p46100 | ATRX | Transcriptional regulator ATRX/X-linked helicase II/X-linked nuclear protein | yhl002w | p19174 | PLCG1 | 1-phosphatidylinositol-4,5-bisphosphate phosphodiesterase gamma 1/phospholipase C-gamma 1 |
| ynr006w | p80303 | NEFA | DNA binding protein NEFA | yhl002w | p16333 | NCK | Cytoplasmic protein NCK |
| ynr006w | p98174 | FGD1 | Putative RHO/RAC guanine nucleotide exchange factor/faciogenital dyspiasia protein | yhl002w | p14317 | HCLS1 | Hematopoietic lineage cell specific protein |
| ynr006w | q02224 | CENPE | Centromeric protein E/CENP-E protein | yhl002w | p29354 | GRB2 | Growth factor receptor-bound protein 2 |
| ynr006w | q07283 | THH | Trichohyalin | yhl002w | p98171 | RGC1 | RHO-GAP hematopoietic protein C1 |
| ynr006w | q13438 | OS9 | Protein OS-9 precurosor | yhl002w | p46109 | CRKL | Crk-like protein |
| ynr006w | q92794 | MOZ | Monocytic leukemia zinc finger protein | yhl002w | p14813 | SPTA2 | Spectrin alpha chain, brain/nonerythroid alpha-spectrin |
| yol034w | p11055 | MYH3 | Embryonic myosin heavy chain. | Ymr117c | p04264 | KRT1 | Keratin, type II cytoskeletal 1/cytokeratin 1/K1/CK1/67Kd cytokeratin/hair alpha protein |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| yol034w | p12883 | MYH7 | Myosin heavy chain, cardiac muscle beta isoform | Ymr117c | p30622 | RSN | Restin |
| yol034w | p13533 | MYH6 | Myosin heavy chain, cardiac muscle alpha isoform | Ymr117c | p35580 | MYH10 | Myosin heavy chain, nonmuscle type B/ cellular myosin heavy chain, type B/ NMMHC-B |
| yol034w | p15924 | DSP | Desmoplakin I and II | Ymr117c | p11055 | MYH3 | Embryonic myosin heavy chain. |
| yol034w | p49454 | CENPF | CENP-F kinetochore protein | Ymr117c | p42566 | EPS15 | Epidermal growth factor receptor substrate 15 |
| yol034w | q02224 | CENPE | Centromeric protein E/CENP-E protein | Ymr117c | p49454 | CENPF | CENP-F kinetochore protein |
| yol059w | p21695 | GPD1 | L-glycerol-3-phosphate dehydrogenase [NAD+] | yfl017c | p08578 | SNRPE | Small nuclear ribonucleoprotein E/ snRNP-E |
| yol061w | p09329 | PRPS1 | Phosphoribosyl pyrophosphate synthetase I/ribosephosphate pyrophosphokinase I | yer099c | p09329 | PRPS1 | Phosphoribosyl pyrophosphate synthetase I/ribosephosphate pyrophosphokinase 1 |
| yol061w | p11908 | PRPS2 | Phosphoriobosyl pyrophosphate synthetase subunit II | yer099c | p11908 | PRPS2 | Phosphoribosyl pyrophosphate synthetase subunit II |
| yol061w | p21108 | PRPS3 | Phosphoribosyl pyrophosphate synthetase subunit III | yer099c | p21108 | PRPS3 | Phosphoribosyl pyrophosphate synthetase subunit III |
| yol069w | p15924 | DSP | Desmoplakin I and II | yer099c | p21108 | PRPS3 | Phosphoribosyl pyrophosphate synthetase subunit III |
| yol069w | p49454 | CENPF | CENP-F kinetochore protein | yer099c | p11908 | PRPS2 | Phosphoribosyl pyrophosphate synthetase subunit II |
| yol069w | q02224 | CENPE | Centromeric protein E/CENP-E protein | yer099c | p09329 | PRPS1 | PHOSPHORIBOSYLPYROPHOSPHATE SYNTHETASE I |
| yol069w | p12270 | TPR | Nucleoprotein TPR | ylr423c | p05787 | KRT8 | Keratin, type II cytoskeletal 8/ cytokeratin 8/K8/CK8 |
| yol069w | p12883 | MYH7 | Myosin heavy chain, cardiac muscle beta isoform | ylr423c | p30622 | RSN | Restin |
| yol069w | p13533 | MYH6 | Myosin heavy chain, cardiac muscle alpha isoform | ylr423c | p13535 | MYH8 | Myosin heavy chain, perinatal skeletal muscle |
| yol069w | p13535 | MYH8 | Myosin heavy chain, perinatal skeletal muscle | ylr423c | q15431 | SYCP1 | Synaptonemal complex protein 1/SCP-1 protein |
| yol069w | p15924 | DSP | Desmoplakin I and II | ylr423c | p15924 | DSP | Oesmoplakin I and II |
| yol069w | p30622 | RSN | Restin | ylrA23c | p11047 | LAMC1 | Laminin gamma-1 chain [precursor]/ aminin B2 chain |
| yol069w | p35580 | MYH10 | Myosin heavy chain, nonmuscle type B/ cellular myosin heavy chain, type B/ NMMHC-B | ylr423c | p12270 | TPR | Nucleoprotein TPR |
| yol069w | p49454 | CENPF | CENP-F kinetochore protein | ylr423c | p49454 | CENPF | CENP-F kinetochore protein |
| yol069w | q02224 | CENPE | Centromeric protein E/CENP-E protein | ylr423c | q02224 | CENPE | Centromeric protein E/CENP-E protein |
| yol088c | p13667 | ERP72 | Protein disulfide isomerase related protein/ERP72 | yhr091c | p54136 | RARS | ArgRS/arginyl-tRNA synthetase |
| yol105c | q02505 | MUC3 | Mucin 3 [fragments]/intestinal mucin 3 | ygl153w | q02224 | CENPE | Centromeric protein E/CENP-E protein |
| yol105c | q99102 | MUC4 | Tracheo-bronchial mucin 4/mucin 4 [fragment] | ygl153w | q03001 | BPAG1 | Bullous 230 kDa pemphigoid antigen 1 |
| yol108c | p98171 | RGC1 | RHO-GAP hematopoietic protein C1 | ykl017c | p38935 | IGHMBP2 | DNA-binding protein SMBP2 |
| yol108c | p98171 | RGC1 | RHO-GAP hematopoietic protein C1 | ykl135c | q10567 | ADTB1 | Beta-adaptin 1 |
| yol108c | p98171 | RGC1 | RHO-GAP hematopoietic proteir C1 | Ymr317w | q02817 | MUC2 | Intestinal mucin 2/mucin 2 |
| yol111c | p11441 | GDX | Ubiquitin-like protein GDX | yor007c | p50502 | HIP | Progesterone receptor-associated p48 protein |
| yol111c | p54725 | RAD23A | UV excision repair protein protein RAD23 homolog A/HHR23A | yor007c | p30260 | CDC27 | Protein CDC27HS/cell division cycle protein 27 homolog |
| yol111c | p54727 | D21090 | UV excision repair protein protein RAD23 homolog B/XP-C repair complementing protein (p58/HHR23B), complete cds. | yor007c | q08752 | PPID | 40 kD peptidyl-prolyl CIS-TRANS isomerase/cyclophilin-40 mRNA, complete cds. |
| yol123w | p07029 | UP2 | Heterogeneous nuclear ribonucleo-protein UP2 | ygl122c | p20226 | TBP | TATA-binding protein/transcription initiation factor TFIID |
| yol123w | p09651 | HNRPA1 | Heterogenous nuclear ribonucleo-protein A1/helix-destabilizing protein/single-strand binding protein/HNRNP core protein A1 | ygl122c | q10571 | MN1 | Probable tumor suppressor protein MN1 |
| yol123w | p11940 | PABPL1 | PolyA binding protein 1 | ygl122c | q14814 | MEF2D | Myocyte-specific enhancer factor 2D |
| yol123w | p22626 | HNRPA2B1 | Heterogeneous nuclear ribonucleo-proteins A2/B1 | ygl122c | p51531 | SMARCA2 | Possible global transcription activator SNF2L2/BRM |
| yol123w | p26378 | ELAVL4 | Paraneoplasticencephalomyelitis antigen 3 | ygl122c | FA2858 | HD | Huntingtin/huntington's disease protein |
| yol123w | p38159 | HNRPG | Heterogeneous nuclear ribonucleo-protein G/HNRNP G/glycoprotein P43 | ygl122c | q92794 | MOZ | Monocytic leukemia zinc finger protein |
| yol123w | q15427 | SAP49 | Spliceosome associated protein 49/ SAP49 | ygl122c | q93074 | KIAA0192 | Hypothetical protein KIAA0192 |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| yol130w | p46821 | MAP1B | Microtubule-associated protein 1B | ygl025c | q02078 | MEF2A | Myocyte-specific enhancer factor 2D |
| yol130w | q04724 | TLE1 | Transducin-like enhancer protein | ygl025c | q02817 | MUC2 | Intestinal mucin 2/mucin 2 |
| yol130w | p46821 | MAP1B | Microtubule-associated protein 1B | ylr291c | q14232 | ELF2B1 | Translation initiation factor eIF-2B alpha subunit |
| yol130w | q04724 | TLE1 | Transducin-like enhancer protein | ylr291c | p49770 | EIF2B2 | Translation initiation factor EIF-2B beta subunit/S20iii15 |
| yor061w | p24941 | CDK2 | Cell division protein kinase 2 | yor030w | p13862 | CSNK2B | Casein kinase II beta subunit |
| yor128c | p22234 | PAICS | ADE2 showing homologies to SAICAR synthetase and AIR carboxylase of the purine pathway | ycr066w | p35226 | BMI1 | DNA-binding protein BMI1 |
| yor128c | p22234 | PAICS | ADE2 showing homologies to SAICAR synthetase and AIR carboxylase of the purine pathway | ycr067c | p42568 | MLLT3 | AF-9 protein |
| yor128c | p22234 | PAICS | ADE2 showing homologies to SAICAR synthetase and AIR carboxylase of the purine pathway | yor128c | p22234 | PAICS | ADE2 showing homologies to SAICAR synthetase and AIR carboxylase of the purine pathway |
| yor132w | q00839 | HNRNPU | Heterogenous nuclear ribonucleoprotein U/scaffold attachment factor A | yor060w | q12840 | KIF5C | Neuronal kinesin heavy chain |
| yor269w | p25388 | GNB2-RS1 | Guanine nucleotide-binding protein beta subunit-like protein 12.3 | ylr254c | p49454 | CENPF | CENP-F kinetochore protein |
| yor260w | p35606 | COPP | Beta subunit of coatomer complex | ylr254c | q02224 | CENPE | Centromeric protein E/CENP-E protein |
| yor269w | p43034 | PAFAH1B1 | Platelet-activating factor acetyl-hydrolase IB alpha subunit | ylr254c | p13533 | MYH6 | Myosin heavy chain, cardiac muscle alpha isoform |
| yor303w | p31327 | CPS1 | Carbamoyl-phosphate synthase [ammonia], mitochondrial [precursor] | yor039w | p13862 | CSNK2B | Casein kinase II beta subunit |
| yor348c | p52569 | SLC7A2 | Low-affinity cationic amino acid transporter-2/CAT-2 | ycr045c | p29144 | TTP2 | Tripeptidyl-peptidase II |
| yor348c | p52569 | SLC7A2 | Low-affinity cationic amino acid transporter-2/CAT-2 | yjl084c | q03164 | MLL | Zinc finger protein HRX |
| yor348c | p52569 | SLC7A2 | Low-affinity cationic amino acid transporter-2/CAT-2 | Ymr228w | q01082 | SPTB2 | Beta-spectrin chain, brain |
| yor353c | p22792 | CPN2 | Carboxypeptidase N | ygr120c | p49454 | CENPF | CENP-F kinetochore protein |
| yor353c | p35858 | IGFALS | IGF binding protein complex acid-labile | ygr120c | p04114 | APOB | Apolipoprotein B |
| yor353c | q06828 | FMOD | Fibromodulin | ygr120c | p30622 | RSN | Restin |
| yor353c | p07585 | DCN | Bone proteoglycan II [precursor]/PG40 | yhr102w | q13177 | PAK2 | Serine/threonine-protein kinase PAK-gamma |
| yor353c | p22792 | CPN2 | Carboxypeptidase N | yhr102w | q02750 | PRKMK1 | Dual specificity mitogen-activated protein kinase kinase 1 |
| yor353c | p23515 | OMG | Oligodendrocyte-myelin glycoprotein | yhr102w | q13153 | PAK1 | Serine/threonine-protein kinase PAK-alpha |
| yor353c | p35858 | IGFALS | IGF binding protein complex acid-labile | yhr102w | q99759 | MAP3K3 | Mitogen-activated protein kinase kinase kinase 3/MEK kinase 3 |
| yor353c | q06828 | FMOD | Fibromodulin | yhr102w | p45985 | MAP2K4 | Dual specificity mitogen-activated protein kinase kinase 4 |
| yor353c | q14392 | GARP | Garp protein/Garpin | yhr102w | q13163 | MAP2K5 | Dual specificity mitogen-activated protein kinase kinase 5 |
| y0r353c | q99102 | MUC4 | Tracheo-bronchial mucin 4/mucin 4 [fragment] | yhr102w | p51955 | NEK2 | Serine/threonine-protein kinase NEK2 |
| yor362c | p25786 | PSMA1 | Proteasome subunit C2. | yfl017c | p08578 | SNRPE | Small nuclear ribonucleoprotein E/snRNP-E |
| yor375c | p00367 | GLUD1 | Glutamate dehydrogenase 1 | yjl124c | p14678 | SNRPB | Small nuclear ribonucleoprotein associated proteins B and B' |
| yor375c | p49448 | GLUD2 | Glutamate dehydrogenase 2 | yjl124c | p14648 | SNRPN | Small nuclear ribonucleoprotein associated protein N |
| ypl049c | p51825 | MLLT2 | AF-4 protein | ydr480w | p17931 | LGALS3 | Galectin-3/IgE-binding protein |
| ypl059w | p35754 | GLRX | Glutaredoxin. | yil105c | p20226 | TBP | TATA-binding protein/transcription initiation factor TFIID |
| ypl059w | p35754 | GLRX | Glutaredoxin. | ynl047c | q99418 | ARNO | ARF nucleotide-binding site opener/ARNO protein/ARF exchange factor |
| ypl140c | p45985 | MAP2K4 | Dual specificity mitogen-activated protein kinase kinase 4 | yhr030c | q15759 | MAPK11 | Mitogen-activated protein kinase 11 |
| ypl140c | p46734 | MAP2K3 | Dual specificity mitogen-activated protein kinase kinase 3/MAP kinase kinase 3 | yhr030c | p53778 | MAPK12 | Mitogen-activated protein kinase 12/ERK6/extracellular signal-regulated kinase 6 |
| ypl140c | p52564 | MAP2K6 | Dual specificity mitogen-activated protein kinas kinase 6 | yhr030c | p27361 | MAPK3 | Mitogen-activated protein kinase 3/extracellular signal-regulated kinase 1 |
| ypl140c | q02750 | PRKMK1 | Dual specificity mitogen-activated protein kinase kinase 1 | yhr030c | q13164 | MAPK7 | Mitogen-activated protein kinase 7/ERK5 |
| ypl140c | q13163 | MAP2KS | Dual specificity mitogen-activated protein kinase kinase 5 | yhr030c | q16539 | MAPK14 | Mitogen-activated protein kinase 14/CSBP |
| ypl140c | q99759 | MAP3K3 | Mitogen-activated protein kinase kinase kinase 3/MEK kinase 3 | yhr030c | p28482 | MAPK1 | Mitogen-activated protein kinase 1/extracellular signal-regulated kinase 2 |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| ypl151c | p35606 | COPP | Beta subunit of coatomer complex | yor036w | q02224 | CENPE | Centromeric protein E/CENP-E protein |
| ypl151c | p43034 | PAFAH1B1 | Platelet-activating factor acetyl-hydrolase IB alpha subunit | yor036w | p49454 | CENPF | CENP-F kinetochore protein |
| ypl151c | q15542 | TAF2D | Transcription initiation factor TFIID 100 Kd subunit/TAFII-100/TAFII100 | yor036w | p35580 | MYH10 | Myosin heavy chain, nonmuscle type B/ cellular myosin heavy chain, type B/ NMMHC-B |
| ypl174c | p49454 | CENPF | CENP-F kinetochore protein | yhr129c | p42024 | ACTR1A | Alpha-centractin |
| ypl174c | q02224 | CENPE | Centromeric protein E/CENP-E protein | yhr129c | p42025 | ACTR1B | Beta-centractin |
| ypl174c | p11055 | MYH3 | Embryonic myosin heavy chain. | yil144w | p11055 | MYH3 | Embryonic myosin heavy chain. |
| ypl174c | p12882 | MYSS | Myosin heavy chain skeletal muscle, light meromyosin regl0n | yil144w | p30622 | RSN | Restin |
| ypl174c | p12883 | MYH7 | Myosin heavy chain, cardiac muscle beta isoform | yil144w | p12883 | MYH7 | Myosin heavy chain, cardiac muscle beta isoform |
| ypl174c | p13533 | MYH6 | Myosin heavy chain, cardiac muscle alpha isoform | yil144w | p13533 | MYH6 | Myosin heavy chain, cardiac muscle alpha isoform |
| ypl174c | p30622 | RSN | Restin | yil144w | p35579 | MYH9 | Myosin heavy chain, nonmuscle type A/ cellular myosin heavy chain, type A/ NMMHC-A |
| ypl174c | p35580 | MYH10 | Myosin heavy chain, nonmuscle type B/ cellular myosin heavy chain, type B/ NMMHC-B | yil144w | p13535 | MYH8 | Myosin heavy chain, perinatal skeletal muscle |
| ypl174c | p49454 | CENPF | CENP-F kinetochore protein | yil144w | p49454 | CENPF | CENP-F kinetochore protein |
| ypl174c | q02224 | CENPE | Centromeric protein E/CENP-E protein | yil144w | q02224 | CENPE | Centromeric protein E/CENP-E protein |
| ypl174c | q14203 | DCTN1 | Dynactin, 150 kD isoform [fragment] | yil144w | p15924 | DSP | Desmoplakin I and II |
| ypl174c | p11055 | MYH3 | Embryonic myosin heavy chain. | ylr423c | p12270 | TPR | Nucleoprotein TPR |
| ypl174c | p12882 | MYSS | Myosin heavy chain skeletal muscle, light meromyosin region | ylr423c | p11047 | LAMC1 | Laminin gamma-1 chain [precursor]/ laminin B2 chain |
| ypl174c | p12883 | MYH7 | Myosin heavy chain, cardiac muscle beta isoform | ylr423c | p30622 | RSN | Restin |
| ypl174c | p13533 | MYH6 | Myosin heavy chain, cardiac muscle alpha isoform | ylr423c | p13535 | MYH8 | Myosin heavy chain, perinatal skeletal muscle |
| ypl174c | p30622 | RSN | Restin | ylr423c | p05787 | KRT8 | Keratin, type II cytoskeletal 8/ cytokeratin 8/K8/CK8 |
| ypl174c | p35580 | MYH10 | Myosin heavy chain, nonmuscle type B/ cellular myosin heavy chain, type B/ NMMHC-B | ylr423c | q15431 | SYCP1 | Synaptonemal complex protein 1/SCP-1 protein |
| ypl174c | p49454 | CENPF | CENP-F kinetochore protein | ylr423c | p49454 | CENPF | CENP-F kinetochore protein |
| ypl174c | q02224 | CENPE | Centromeric protein E/CENP-E protein | ylr423c | q02224 | CENPE | Centromeric protein E/CENP-E protein |
| ypl174c | q14203 | DCTN1 | Dynactin, 150 kD isoform [fragment] | ylr423c | p15924 | DSP | Desmoplakin I and II |
| ypl259c | p53677 | P47B | Clathrin coat assembly protein AP47 homolog 2 | ykl135c | q10567 | ADTB1 | Beta-adaptin 1 |
| ypl259c | p53680 | CLAPS2 | Clathrin coat assembly protein AP17/ clathrin coat associated protein AP17 | ykl135c | p21851 | CLAPB1 | Beta adaptin |
| ypl260w | p12270 | TPR | Nucleoprotein TPR | yil144w | p12883 | MYH7 | Myosin heavy chain, cardiac muscle beta isoform |
| ypl260w | p17661 | DES | Desmin | yil144w | p30622 | RSN | Restin |
| ypl260w | p33176 | KNS1 | Kinesin heavy chain | yil144w | p15924 | DSP | Desmoplakin I and II |
| ypl260w | p49454 | CENPF | CENP-F kinetochore protein | yil144w | p49454 | CENPF | CENP-F kinetochore protein |
| ypl260w | q02224 | CENPE | Centromeric protein E/CENP-E protein | yil144w | q02224 | CENPE | Centromeric protein E/CENP-E protein |
| ypl260w | q15032 | KIAA0029 | Hypothetical protein KIAA0029 | yil144w | p13535 | MYH8 | Myosin heavy chain, perinatal skeletal muscle |
| ypl260w | q15431 | SYCP1 | Synaptonemal complex protein 1/SCP-1 protein | yil144w | p11055 | MYH3 | Embryonic myosin heavy chain. |
| ypl260w | q16787 | LAMA3 | Laminin alpha-3 chain | yil144w | p13533 | MYH6 | Myosin heavy chain, cardiac muscle alpha isoform |
| ypr018w | p35241 | RDX | Radixin | ybr195c | o00628 | PTS2R | Peroxisomal targeting signal 2 receptor |
| ypr018w | p35580 | MYH10 | Myosin heavy chain, nonmuscle type B/ cellular myosin heavy chain, type B/ NMMHC-B | ybr195c | p04901 | GNB1 | Guanine nucleotide-binding protein G(I)/G(S)/G(T) beta subunit 1 |
| ypr018w | p46821 | MAP1B | Microtubule-associated protein 1B | ybr195c | q09028 | RBAP48 | Chromatin assembly factor 1 P48 subunit/retinoblastoma binding protein P48 |
| ypr018w | q02832 | BLSA | B-lymphocyte antigen/B-lymphocyte surface antigen | ybr195c | p11016 | GNB2 | Guanine nucleotide-binding protein beta subunit 2 |
| ypr018w | q14203 | DCTN1 | Dynactin, 150 kD isoform [fragment] | ybr195c | q16576 | RBBP7 | Histone acetyl transferase type B subunit 2/retinoblastoma-binding protein |
| ypr018w | q16643 | DBN1 | Drebin E | ybr195c | p16520 | GNB3 | Guanine nucleotide-binding protein G(I)/G(S)/G(T) beta subunit 3 |
| ypr048w | p29475 | NOS1 | Nitric oxide synthase/neuronal NOS | yor355w | p42568 | MLLT3 | AF-9 protein |
| ypr048w | p35228 | NOS2 | Inducible nitric oxide synthase | y0r355w | q14669 | TRIP12 | Thyroid receptor interacting protein 12/ KIAA0045 |

TABLE 7-continued

Human ortholog protein interactions

| Yeast accno (bait) | Human ortholog accno | Human ortholog name | Human ortholog description | Yeast accno (prey) | Human ortholog accno | Human ortholog name | Human ortholog description |
|---|---|---|---|---|---|---|---|
| ypr054w | p28482 | MAPK1 | Mitogen-activated protein kinase 1/ extracellular signal-regulated kinase 2 | yfl029c | p24941 | CDK2 | Cell division protein kinase 2 |
| ypr054w | p53778 | MAPK12 | Mitogen-activated protein kinase 12/ERKB/extracellular signal-regulated kinase 6 | yfl029c | p50613 | CDK7 | Cell division protein kinase 7/CAK/ CDK-activating kinase |
| ypr054w | p53779 | MAPK10 | Mitogen-activated protein kinase 10 | yfl029c | p49540 | GSK3A | Glycogen synthase kinase-3 alpha |
| ypr054w | q13164 | MAPK7 | Mitogen-activated protein kinase 7/ ERKS | yfl029c | q00526 | CDK3 | Cell division protein kinase 3 |
| ypr054w | q15759 | MAPK11 | Mitogen-activated protein kinase 11 | yfl029c | p49841 | GSK3B | Glycogen synthase kinase-3 beta |
| ypr054w | q16539 | MAPK14 | Mitogen-activated protein kinase 14/ CSBP | yfl029c | q00535 | CDK5 | Cell division protein kinase 5/TAU protein kinase II catalytic subunit/TPKII catalytic subunit |
| ypr105c | p07197 | NEFM | Neurofilament triplet M protein/160 Kd neurofilament protein/NF-M | ygl14sw | p35749 | MYH11 | Myosin heavy chain, smooth muscle isoform/SMMHC [FRAGMENT] |
| ypr105c | p07197 | NEFM | Neurofilament triplet M protein/160 Kd neurofilament protein/NF-M | ygl153w | q03001 | BPAG1 | Bullous 230 kDa pemphigoid antigen 1 |
| ypr105c | p07197 | NEFM | Neurofilament triplet M protein/160 Kd neurofilament protein/NF-M | ygr120c | p04114 | APOB | Apolipoprotein B |
| ypr105c | p07197 | NEFM | Neurofilament triplet M protein/160 Kd neurofilament protein/NF-M | yhr060w | p25789 | PSMA4 | Proteasome subunit C9 |
| ypr110c | p19387 | POLR2C | DNA-directed RNA polymerase II 33Kd subunit/RPB33 | ylr238w | p49454 | CENPF | CENP-F kinetochore protein |
| ypr110c | p19387 | POLR2C | DNA-directed RNA polymerase II 33Kd subunit/RPB33 | ynl113w | q06481 | APLP2 | Amyloid-like protein 2/APPH/amyloid protein homolog |
| ypr119w | p14635 | CCNB1 | G2/mitotic-specific cyclin B1 | ybr135w | p33551 | CKS1 | Cyclin-dependent kinases regulatory subunit 1 |
| ypr119w | p20248 | CCNA | G2/mitotic-specific cyclin A. | ybr135w | p10275 | AR | Androgen receptor |
| ypr119w | p14635 | CCNB1 | G2/mitotic-specific cyclin B1 | ydr412w | p36777 | LONN | Lon protease-like protein |
| ypr119w | p20248 | CCNA | G2/mitotic-specific cyclin A. | ydr412w | p36776 | LONM | Mitochondrial LON protease homolog [precursor] |
| ypr119w | p14635 | CCNB1 | G2/mitotic-specific cyclin B1 | yhr035w | q15437 | SEC23B | Protein transprot protein Sec23 B isoform |
| ypr119w | p20248 | CCNA | G2/mitotic-specific cyclin A. | yhr035w | q15436 | SEC23A | Protein transprot protein Sec23 A isoform |
| ypr119w | p14635 | CCNB1 | G2/mitotic-specific cyclin B1 | ynl135c | q00688 | FKBP3 | Rapamycin-selective 25 Kd immuno-philin |
| ypr119w | p20248 | CCNA | G2/mitotic-specific cyclin A. | ynl135c | p26885 | FKBP2 | FK506-binding protein/FKBp-13 |
| ypr173c | q03527 | PSMC1 | 26S protease (54) regulatory subunit | ylr025w | p14314 | PRKCSH | Protein kinase C substrate, 80 kD protein, heavy chain/80K-H protein |
| ypr173c | q13608 | PEX6 | Peroxisome assembly factor-2/ peroxisomal-type ATPase 1 | ylr025w | q14203 | DCTN1 | Dynactin, 150 kD isoform [fragment] |
| ypr185w | p20226 | TBP | TATA-binding protein/transcription initiation factor TFIID | ygl180w | p22694 | PRKACB | Testis-specific cAMP-dependent protein kinase catalytic subunit C-beta isoform |
| ypr185w | p51531 | SMARCA2 | Possible global transcription activator SNF2L2/BRM | ygl180w | p17612 | PRKACA | cAMP-dependent protein kinase catalytic subunit type alpha |
| ypr185w | p54252 | MJD1 | Machado-joseph disease protein 1 | ygl180w | p54646 | PRKAA2 | 5'-AMP-activated protein kinase, catalytic alpha-2 chain |
| ypr185w | q10571 | MN1 | Probable tumor suppressor protein MN1 | ygl180w | q04759 | PRKCQ | Protein kinase C-theta type |
| ypr185w | q93074 | KIM0192 | Hypothetical protein KIAA0192 | ygl180w | p27448 | P78 | Putative serind/threonine-protein kinase P78 |
| ypr185w | p20226 | TBP | TATA-binding protein/transcription initiation factor TFIID | ygr120c | p30622 | RSN | Restin |
| ypr185w | p51531 | SMARCA2 | Possible global transcription activator SNF2L2/BRM | ygr120c | p49454 | CENPF | CENP-F kinetochore protein |
| ypr185w | p54252 | MJD1 | Machado-joseph disease protein 1 | ygr120c | p04114 | APOB | Apolipoprotein B |
| ypr185w | p20226 | TBP | TATA-binding protein/transcription initiation factor TFIID | ygr253c | p25788 | PSMA3 | Proteasome subunit C8 |
| ypr185w | p51531 | SMARCA2 | Possible global transcription activator SNF2L2/BRM | ygr253c | p25787 | PSMA2 | Proteasome subunit C3 |
| ypr185w | p54252 | MJD1 | Machado-joseph disease protein 1 | ygr253c | p25786 | PSMA1 | Proteasome subunit C2. |
| ypr185w | q10571 | MN1 | Probable tumor suppressor protein MN1 | ygr253c | p34062 | PSMA6 | Proteasome iota chain/PROS-27 |
| ypr185w | q93074 | KIAA0192 | Hypothetical protein KIAA0192 | ygr253c | p25789 | PSMA4 | Proteasome subunit C9 |
| ypr185w | p20226 | TBP | TATA-binding protein/transcription initiation factor TFIID | ylr423c | p15924 | DSP | Desmoplakin I and II |
| ypr185w | p51531 | SMARCA2 | Possible global transcription activator SNF2L2/BRM | ylr423c | p49454 | CENPF | CENP-F kinetochore protein |
| ypr185w | p54252 | MJD1 | Machado-joseph disease protein 1 | ylr423c | q02224 | CENPE | Centromeric protein E/CENP-E protein |
| ypr185w | q10571 | MN1 | Probable tumor suppressor protein MN1 | ylr423c | p30622 | RSN | Restin |
| ypr185w | q93074 | KIAA0192 | Hypothetical protein KIAA0192 | ylr423c | p13535 | MYH8 | Myosin heavy chain, perinatal skeletal muscle |

The human polypeptides disclosed in Table 7 are related as orthologs to yeast polypeptides that interact to form complexes according to the invention. Table 7 reflects this relationship and specifies a yeast accession number for a given human ortholog. In particular, Table 7 includes in column 1 the yeast accession number for the yeast "bait" sequence corresponding to the indicated human ortholog. Columns 2–4 provide the accession number of the human ortholog, the name of the human ortholog, and a description of the human ortholog, respectively, of the yeast "bait sequence". Column 5 of Table 7 provides the yeast accession number of the yeast "prey" sequence. Columns 6–8 provide the accession number of the human ortholog, the name of the human ortholog, and a description of the human ortholog, respectively, of the yeast "prey sequence".

The Yeast and Human Ortholog Accession Numbers (ACCNO) listed in Table 7 are shown with their corresponding Sequence Identification Numbers (SEQIDNO) in Table 8.

TABLE 8

| ACCNO | SEQIDNO |
|---|---|
| YAL016W | 1 |
| YAL032C | 2 |
| YAL034W-A | 3 |
| YAL036C | 4 |
| YAL040C | 5 |
| YAL049C | 6 |
| YAR003W | 7 |
| YAR014C | 8 |
| YAR031W | 9 |
| YAR033W | 10 |
| YAR066W | 11 |
| YBL007C | 12 |
| YBL010C | 13 |
| YBL014C | 14 |
| YBL021C | 15 |
| YBL025W | 16 |
| YBL042C | 17 |
| YBL043W | 18 |
| YBL051C | 19 |
| YBL078C | 20 |
| YBL101W-A | 21 |
| YBL102W | 22 |
| YBL105C | 23 |
| YBR006W | 24 |
| YBR040W | 25 |
| YBR052C | 26 |
| YBR055C | 27 |
| YBR057C | 28 |
| YBR059C | 29 |
| YBR077C | 30 |
| YBR094W | 31 |
| YBR103W | 32 |
| YBR108W | 33 |
| YBR125C | 34 |
| YBR133C | 35 |
| YBR134W | 36 |
| YBR135W | 37 |
| YBR14TC | 38 |
| YBR154C | 39 |
| YBR170C | 40 |
| YBR175W | 41 |
| YBR176W | 42 |
| YBR184W | 43 |
| YBR188C | 44 |
| YBR190W | 45 |
| YBR193C | 46 |
| YBR194W | 47 |
| YBR195C | 48 |
| YBR196C | 49 |
| YBR205W | 50 |
| YBR217W | 51 |
| YBR221C | 52 |
| YBR228W | 53 |
| YBR237W | 54 |
| YBR244W | 55 |
| YBR252W | 56 |
| YBR253W | 57 |
| YBR254C | 58 |
| YBR270C | 59 |
| YBR274W | 60 |
| YBR281C | 61 |
| YCL020W | 62 |
| YCL024W | 63 |
| YCL032W | 64 |
| YCL040W | 65 |
| YCL046W | 66 |
| YCL054W | 67 |
| YCL055W | 68 |
| YCL059C | 69 |
| YCR004C | 70 |
| YCR009C | 71 |
| YCR011C | 72 |
| YCR020C-A | 73 |
| YCR022C | 74 |
| YCR023C | 75 |
| YCR027C | 76 |
| YCR030C | 77 |
| YCR045C | 78 |
| YCR050C | 79 |
| YCR057C | 80 |
| YCR059C | 81 |
| YCR063W | 82 |
| YCR066W | 83 |
| YCR067C | 84 |
| YCR082W | 85 |
| YCR086W | 86 |
| YCR093W | 87 |
| YCR106W | 88 |
| YDL001W | 89 |
| YDL002C | 90 |
| YDL006W | 91 |
| YDL011C | 92 |
| YDL012C | 93 |
| YDL013W | 94 |
| YDL017W | 95 |
| YDL063C | 96 |
| YDL065C | 97 |
| YDL071C | 98 |
| YDL076C | 99 |
| YDL088C | 100 |
| YDL089W | 101 |
| YDL090C | 102 |
| YDL097C | 103 |
| YDL098C | 104 |
| YDL110C | 105 |
| YDL111C | 106 |
| YDL113C | 107 |
| YDL127W | 108 |
| YDL133W | 109 |
| YDL135C | 110 |
| YDL144C | 111 |
| YDL146W | 112 |
| YDL149W | 113 |
| YDL150W | 114 |
| YDL154W | 115 |
| YDL155W | 116 |
| YDL160C | 117 |
| YDL165W | 118 |
| YDL203C | 119 |
| YDL210W | 120 |
| YDL212W | 121 |
| YDL215C | 122 |
| YDL216C | 123 |
| YDL236W | 124 |
| YDL239C | 125 |
| YDL246C | 126 |
| YDR001C | 127 |
| YDR002W | 128 |
| YDR013W | 129 |
| YDR016C | 130 |

TABLE 8-continued

| ACCNO | SEQIDNO |
|---|---|
| YDR017C | 131 |
| YDR020C | 132 |
| YDR026C | 133 |
| YDR032C | 134 |
| YDR044W | 135 |
| YDR051C | 136 |
| YDR054C | 137 |
| YDR061W | 138 |
| YDR070C | 139 |
| YDR071C | 140 |
| YDR073W | 141 |
| YDR074W | 142 |
| YDR076W | 143 |
| YDR077W | 144 |
| YDR078C | 145 |
| YDR084C | 146 |
| YDR088C | 147 |
| YDR098C | 148 |
| YDR099W | 149 |
| YDR106W | 150 |
| YDR108W | 151 |
| YDR110W | 152 |
| YDR115W | 153 |
| YDR122W | 154 |
| YDR123C | 155 |
| YDR128W | 156 |
| YDR132C | 157 |
| YDR140W | 158 |
| YDR142C | 159 |
| YDR145W | 160 |
| YDR146C | 161 |
| YDR148C | 162 |
| YDR151C | 163 |
| YDR152W | 164 |
| YDR162C | 165 |
| YDR167W | 166 |
| YDR174W | 167 |
| YDR179C | 168 |
| YDR183W | 169 |
| YDR200C | 170 |
| YDR201W | 171 |
| YDR206W | 172 |
| YDR207C | 173 |
| YDR214W | 174 |
| YDR215C | 175 |
| YDR218C | 176 |
| YDR225W | 177 |
| YDR236C | 178 |
| YDR255C | 179 |
| YDR267C | 180 |
| YDR273W | 181 |
| YDR279W | 182 |
| YDR292C | 183 |
| YDR299W | 184 |
| YDR308C | 185 |
| YDR311W | 186 |
| YDR313C | 187 |
| YDR315C | 188 |
| YDR326C | 189 |
| YDR328C | 190 |
| YDR335W | 191 |
| YDR348C | 192 |
| YDR357C | 193 |
| YDR372C | 194 |
| YDR376W | 195 |
| YDR381W | 196 |
| YDR382W | 197 |
| YDR383C | 198 |
| YDR386W | 199 |
| YDR388W | 200 |
| YDR394W | 201 |
| YDR398W | 202 |
| YDR400W | 203 |
| YDR408C | 204 |
| YDR412W | 205 |
| YDR416W | 206 |
| YDR429C | 207 |
| YDR439W | 208 |
| YDR448W | 209 |
| YDR469W | 210 |
| YDR472W | 211 |
| YDR477W | 212 |
| YDR480W | 213 |
| YDR482C | 214 |
| YDR489W | 215 |
| YDR490C | 216 |
| YDR503C | 217 |
| YDR508C | 218 |
| YDR510W | 219 |
| YDR515W | 220 |
| YEL009C | 221 |
| YEL015W | 222 |
| YEL023C | 223 |
| YEL041W | 224 |
| YEL053C | 225 |
| YEL060C | 226 |
| YEL062W | 227 |
| YEL068C | 228 |
| YER007C-A | 229 |
| YER010C | 230 |
| YER016W | 231 |
| YER018C | 232 |
| YER019C-A | 233 |
| YER021W | 234 |
| YER023W | 235 |
| YER027C | 236 |
| YER046W | 237 |
| YER052C | 238 |
| YER059W | 239 |
| YER062C | 240 |
| YER063W | 241 |
| YER065C | 242 |
| YER079W | 243 |
| YER081W | 244 |
| YER082C | 245 |
| YER092W | 246 |
| YER095W | 247 |
| YER099C | 248 |
| YER102W | 249 |
| YER105C | 250 |
| YER106W | 251 |
| YER116C | 252 |
| YER126C | 253 |
| YER127W | 254 |
| YER131W | 255 |
| YER133W | 256 |
| YER144C | 257 |
| YER157W | 258 |
| YER174C | 259 |
| YER179W | 260 |
| YER180C | 261 |
| YER186C | 262 |
| YFL002W-A | 263 |
| YFL009W | 264 |
| YFL010C | 265 |
| YFL017C | 266 |
| YFL023W | 267 |
| YFL029C | 268 |
| YFL035C | 269 |
| YFL056C | 270 |
| YFL059W | 271 |
| YFL060C | 272 |
| YFL061W | 273 |
| YFR002W | 274 |
| YFR008W | 275 |
| YFR024C-A | 276 |
| YFR033C | 277 |
| YFR037C | 278 |
| YFR042W | 279 |
| YFR043C | 280 |
| YFR047C | 281 |
| YFR052W | 282 |
| YFR057W | 283 |
| YGL015C | 284 |

TABLE 8-continued

| ACCNO | SEQIDNO |
|---|---|
| YGL019W | 285 |
| YGL024W | 286 |
| YGL025C | 287 |
| YGL026C | 288 |
| YGL028C | 289 |
| YGL030W | 290 |
| YGL051W | 291 |
| YGL058W | 292 |
| YGL061C | 293 |
| YGL071W | 294 |
| YGL091C | 295 |
| YGL112C | 296 |
| YGL115W | 297 |
| YGL116W | 298 |
| YGL122C | 299 |
| YGL126W | 300 |
| YGL127C | 301 |
| YGL134W | 302 |
| YGL145W | 303 |
| YGL150C | 304 |
| YGL153W | 305 |
| YGL154C | 306 |
| YGL155W | 307 |
| YGL158W | 308 |
| YGL161C | 309 |
| YGL166W | 310 |
| YGL170C | 311 |
| YGL172W | 312 |
| YGL174W | 313 |
| YGL175C | 314 |
| YGL180W | 315 |
| YGL189C | 316 |
| YGL192W | 317 |
| YGL198W | 318 |
| YGL201C | 319 |
| YGL208W | 320 |
| YGL214W | 321 |
| YGL221C | 322 |
| YGL229C | 323 |
| YGL230C | 324 |
| YGL237C | 325 |
| YGL238W | 326 |
| YGL242C | 327 |
| YGL254W | 328 |
| YGR010W | 329 |
| YGR014W | 330 |
| YGR017W | 331 |
| YGR024C | 332 |
| YGR046W | 333 |
| YGR047C | 334 |
| YGR048W | 335 |
| YGR049W | 336 |
| YGR057C | 337 |
| YGR058W | 338 |
| YGR061C | 339 |
| YGR068C | 340 |
| YGR075C | 341 |
| YGR099W | 342 |
| YGR104C | 343 |
| YGR108W | 344 |
| YGR113W | 345 |
| YGR117C | 346 |
| YGR119C | 347 |
| YGR120C | 348 |
| YGR122W | 349 |
| YGR129W | 350 |
| YGR136W | 351 |
| YGR144W | 352 |
| YGR154C | 353 |
| YGR155W | 354 |
| YGR158C | 355 |
| YGR163W | 356 |
| YGR173W | 357 |
| YGR213C | 358 |
| YGR229C | 359 |
| YGR232W | 360 |
| YGR234W | 361 |

TABLE 8-continued

| ACCNO | SEQIDNO |
|---|---|
| YGR239C | 362 |
| YGR250C | 363 |
| YGR252W | 364 |
| YGR253C | 365 |
| YGR267C | 366 |
| YGR268C | 367 |
| YGR269W | 368 |
| YGR278W | 369 |
| YGR294W | 370 |
| YHL002W | 371 |
| YHL006C | 372 |
| YHL009C | 373 |
| YHL018W | 374 |
| YHL019C | 375 |
| YHL025W | 376 |
| YHL027W | 377 |
| YHL042W | 378 |
| YHL046C | 379 |
| YHR014W | 380 |
| YHR016C | 381 |
| YHR030C | 382 |
| YHR032W | 383 |
| YHR035W | 384 |
| YHR039C | 385 |
| YHR057C | 386 |
| YHR060W | 387 |
| YHR084W | 388 |
| YHR091C | 389 |
| YHR102W | 390 |
| YHR111W | 391 |
| YHR115C | 392 |
| YHR122W | 393 |
| YHR128W | 394 |
| YHR129C | 395 |
| YHR134W | 396 |
| YHR140W | 397 |
| YHR145C | 398 |
| YHR158C | 399 |
| YHR160C | 400 |
| YHR170W | 401 |
| YHR171W | 402 |
| YHR184W | 403 |
| YHR185C | 404 |
| YHR187W | 405 |
| YHR193C | 406 |
| YHR204W | 407 |
| YHR207C | 408 |
| YHR215W | 409 |
| YIL007C | 410 |
| YIL008W | 411 |
| YIL011W | 412 |
| YIL013C | 413 |
| YIL033C | 414 |
| YIL065C | 415 |
| YIL074C | 416 |
| YIL082W | 417 |
| YIL105C | 418 |
| YIL112W | 419 |
| YIL132C | 420 |
| YIL144W | 421 |
| YIL150C | 422 |
| YIL151C | 423 |
| YIL160C | 424 |
| YIL163C | 425 |
| YIL172C | 426 |
| YIR001C | 427 |
| YIR005W | 428 |
| YIR018W | 429 |
| YIR024C | 430 |
| YIR032C | 431 |
| YIR037W | 432 |
| YIR044C | 433 |
| YJL001W | 434 |
| YJL013C | 435 |
| YJL025W | 436 |
| YJL030W | 437 |
| YJL036W | 438 |

TABLE 8-continued

| ACCNO | SEQIDNO |
|---|---|
| YJL041W | 439 |
| YJL048C | 440 |
| YJL056C | 441 |
| YJL057C | 442 |
| YJL064W | 443 |
| YJL065C | 444 |
| YJL084C | 445 |
| YJL088W | 446 |
| YJL092W | 447 |
| YJL110C | 448 |
| YJL112W | 449 |
| YJL124C | 450 |
| YJL137C | 451 |
| YJL154C | 452 |
| YJL160C | 453 |
| YJL162C | 454 |
| YJL178C | 455 |
| YJL184W | 456 |
| YJL185C | 457 |
| YJL211C | 458 |
| YJL218W | 459 |
| YJR009C | 460 |
| YJR024C | 461 |
| YJR034W | 462 |
| YJR049C | 463 |
| YJR050W | 464 |
| YJR072C | 465 |
| YJR074W | 466 |
| YJR076C | 467 |
| YJR086W | 468 |
| YJR091C | 469 |
| YJR093C | 470 |
| YJR094C | 471 |
| YJR117W | 472 |
| YJR122W | 473 |
| YJR125C | 474 |
| YJR133W | 475 |
| YJR135C | 476 |
| YJR136C | 477 |
| YJR159W | 478 |
| YKL001C | 479 |
| YKL002W | 480 |
| YKL012W | 481 |
| YKL015W | 482 |
| YKL017C | 483 |
| YKL019W | 484 |
| YKL023W | 485 |
| YKL028W | 486 |
| YKL033W | 487 |
| YKL039W | 488 |
| YKL052C | 489 |
| YKL061W | 490 |
| YKL067W | 491 |
| YKL070W | 492 |
| YKL075C | 493 |
| YKL090W | 494 |
| YKL103C | 495 |
| YKL110C | 496 |
| YKL130C | 497 |
| YKL135C | 498 |
| YKL142W | 499 |
| YKL144C | 500 |
| YKL166C | 501 |
| YKL183W | 502 |
| YKL204W | 503 |
| YKR007W | 504 |
| YKR011C | 505 |
| YKR022C | 506 |
| YKR024C | 507 |
| YKR025W | 508 |
| YKR026C | 509 |
| YKR037C | 510 |
| YKR048C | 511 |
| YKR055W | 512 |
| YKR060W | 513 |
| YKR062W | 514 |
| YKR068C | 515 |

TABLE 8-continued

| ACCNO | SEQIDNO |
|---|---|
| YKR083C | 516 |
| YKR096W | 517 |
| YKR099W | 518 |
| YKR104W | 519 |
| YLL001W | 520 |
| YLL027W | 521 |
| YLL028W | 522 |
| YLL032C | 523 |
| YLL046C | 524 |
| YLL049W | 525 |
| YLL057C | 526 |
| YLL062C | 527 |
| YLR015W | 528 |
| YLR025W | 529 |
| YLR046C | 530 |
| YLR049C | 531 |
| YLR065C | 532 |
| YLR071C | 533 |
| YLR072W | 534 |
| YLR082C | 535 |
| YLR098C | 536 |
| YLR102C | 537 |
| YLR113W | 538 |
| YLR117C | 539 |
| YLR121C | 540 |
| YLR135W | 541 |
| YLR150W | 542 |
| YLR154C | 543 |
| YLR190W | 544 |
| YLR200W | 545 |
| YLR208W | 546 |
| YLR215C | 547 |
| YLR216C | 548 |
| YLR229C | 549 |
| YLR238W | 550 |
| YLR243W | 551 |
| YLR245C | 552 |
| YLR254C | 553 |
| YLR258W | 554 |
| YLR264W | 555 |
| YLR270W | 556 |
| YLR275W | 557 |
| YLR284C | 558 |
| YLR288C | 559 |
| YLR291C | 560 |
| YLR293C | 561 |
| YLR294C | 562 |
| YLR303W | 563 |
| YLR305C | 564 |
| YLR312C | 565 |
| YLR315W | 566 |
| YLR319C | 567 |
| YLR321C | 568 |
| YLR322W | 569 |
| YLR323C | 570 |
| YLR324W | 571 |
| YLR328W | 572 |
| YLR345W | 573 |
| YLR352W | 574 |
| YLR362W | 575 |
| YLR376C | 576 |
| YLR386W | 577 |
| YLR390W | 578 |
| YLR392C | 579 |
| YLR403W | 580 |
| YLR417W | 581 |
| YLR424W | 582 |
| YLR429W | 583 |
| YLR432W | 584 |
| YLR433C | 585 |
| YLR435W | 586 |
| YLR438W | 587 |
| YLR447C | 588 |
| YLR465C | 589 |
| YLR466W | 590 |
| YML006C | 591 |
| YML015C | 592 |

TABLE 8-continued

| ACCNO | SEQIDNO |
|---|---|
| YML028W | 593 |
| YML031W | 594 |
| YML032C-A | 595 |
| YML035C | 596 |
| YML053C | 597 |
| YML068W | 598 |
| YML088W | 599 |
| YML094W | 600 |
| YML099C | 601 |
| YML109W | 602 |
| YML114C | 603 |
| YML119W | 604 |
| YML121W | 605 |
| YMR004W | 606 |
| YMR025W | 607 |
| YMR039C | 608 |
| YMR052W | 609 |
| YMR068W | 610 |
| YMR075C-A | 611 |
| YMR077C | 612 |
| YMR079W | 613 |
| YMR091C | 614 |
| YMR092C | 615 |
| YMR093W | 616 |
| YMR095C | 617 |
| YMR096W | 618 |
| YMR102C | 619 |
| YMR112C | 620 |
| YMR117C | 621 |
| YMR129W | 622 |
| YMR139W | 623 |
| YMR153W | 624 |
| YMR159C | 625 |
| YMR163C | 626 |
| YMR165C | 627 |
| YMR180C | 628 |
| YMR181C | 629 |
| YMR201C | 630 |
| YMR210W | 631 |
| YMR224C | 632 |
| YMR226C | 633 |
| YMR228W | 634 |
| YMR233W | 635 |
| YMR236W | 636 |
| YMR243C | 637 |
| YMR255W | 638 |
| YMR267W | 639 |
| YMR269W | 640 |
| YMR270C | 641 |
| YMR295C | 642 |
| YMR309C | 643 |
| YMR312W | 644 |
| YMR314W | 645 |
| YMR316C-B | 646 |
| YMR317W | 647 |
| YMR322C | 648 |
| YNL021W | 649 |
| YNL023C | 650 |
| YNL025C | 651 |
| YNL032W | 652 |
| YNL042W | 653 |
| YNL047C | 654 |
| YNL056W | 655 |
| YNL078W | 656 |
| YNL086W | 657 |
| YNL091W | 658 |
| YNL093W | 659 |
| YNL094W | 660 |
| YNL099C | 661 |
| YNL104C | 662 |
| YNL113W | 663 |
| YNL118C | 664 |
| YNL122C | 665 |
| YNL127W | 666 |
| YNL135C | 667 |
| YNL154C | 668 |
| YNL155W | 669 |
| YNL164C | 670 |
| YNL171C | 671 |
| YNL189W | 672 |
| YNL199C | 673 |
| YNL201C | 674 |
| YNL210W | 675 |
| YNL218W | 676 |
| YNL229C | 677 |
| YNL233W | 678 |
| YNL236W | 679 |
| YNL244C | 680 |
| YNL279W | 681 |
| YNL287W | 682 |
| YNL288W | 683 |
| YNL311C | 684 |
| YNL314W | 685 |
| YNL333W | 686 |
| YNR004W | 687 |
| YNR005C | 688 |
| YNR006W | 689 |
| YNR007C | 690 |
| YNR010W | 691 |
| YNR012W | 692 |
| YNR022C | 693 |
| YNR025C | 694 |
| YNR029C | 695 |
| YNR048W | 696 |
| YNR052C | 697 |
| YNR068C | 698 |
| YNR069C | 699 |
| YOL006C | 700 |
| YOL034W | 701 |
| YOL036W | 702 |
| YOL058W | 703 |
| YOL059W | 704 |
| YOL061W | 705 |
| YOL069W | 706 |
| YOL070C | 707 |
| YOL082W | 708 |
| YOL083W | 709 |
| YOL088C | 710 |
| YOL091W | 711 |
| YOL105C | 712 |
| YOL106W | 713 |
| YOL108C | 714 |
| YOL111C | 715 |
| YOL123W | 716 |
| YOL130W | 717 |
| YOL135C | 718 |
| YOL139C | 719 |
| YOL143C | 720 |
| YOL149W | 721 |
| YOR006C | 722 |
| YOR007C | 723 |
| YOR023C | 724 |
| YOR025W | 725 |
| YOR026W | 726 |
| YOR036W | 727 |
| YOR039W | 728 |
| YOR047C | 729 |
| YOR061W | 730 |
| YOR062C | 731 |
| YOR069W | 732 |
| YOR078W | 733 |
| YOR111W | 734 |
| YOR115C | 735 |
| YOR127W | 736 |
| YOR128C | 737 |
| YOR132W | 738 |
| YOR138C | 739 |
| YOR159C | 740 |
| YOR161C | 741 |
| YOR164C | 742 |
| YOR174W | 743 |
| YOR180C | 744 |
| YOR185C | 745 |
| YOR197W | 746 |

TABLE 8-continued

| ACCNO | SEQIDNO |
|---|---|
| YOR202W | 747 |
| YOR210W | 748 |
| YOR212W | 749 |
| YOR215C | 750 |
| YOR220W | 751 |
| YOR226C | 752 |
| YOR262W | 753 |
| YOR264W | 754 |
| YOR269W | 755 |
| YOR276W | 756 |
| YOR284W | 757 |
| YOR303W | 758 |
| YOR331C | 759 |
| YOR348C | 760 |
| YOR353C | 761 |
| YOR355W | 762 |
| YOR358W | 763 |
| YOR362C | 764 |
| YOR368W | 765 |
| YOR372C | 766 |
| YOR375C | 767 |
| YPL002C | 768 |
| YPL003W | 769 |
| YPL019C | 770 |
| YPL031C | 771 |
| YPL039W | 772 |
| YPL049C | 773 |
| YPL059W | 774 |
| YPL070W | 775 |
| YPL088W | 776 |
| YPL110C | 777 |
| YPL111W | 778 |
| YPL128C | 779 |
| YPL131W | 780 |
| YPL133C | 781 |
| YPL140C | 782 |
| YPL149W | 783 |
| YPL151C | 784 |
| YPL157W | 785 |
| YPL161C | 786 |
| YPL174C | 787 |
| YPL175W | 788 |
| YPL192C | 789 |
| YPL201C | 790 |
| YPL204W | 791 |
| YPL211W | 792 |
| YPL214C | 793 |
| YPL222W | 794 |
| YPL229W | 795 |
| YPL259C | 796 |
| YPL260W | 797 |
| YPR018W | 798 |
| YPR020W | 799 |
| YPR040W | 800 |
| YPR046W | 801 |
| YPR048W | 802 |
| YPR051W | 803 |
| YPR054W | 804 |
| YPR062W | 805 |
| YPR066W | 806 |
| YPR070W | 807 |
| YPR082C | 808 |
| YPR105C | 809 |
| YPR107C | 810 |
| YPR110C | 811 |
| YPR115W | 812 |
| YPR119W | 813 |
| YPR152C | 814 |
| YPR159W | 815 |
| YPR173C | 816 |
| YPR182W | 817 |
| YPR185W | 818 |
| O00505 | 819 |
| O00507 | 820 |
| O00628 | 821 |
| O00629 | 822 |
| O00746 | 823 |

TABLE 8-continued

| ACCNO | SEQIDNO |
|---|---|
| O14647 | 824 |
| O14727 | 825 |
| O15016 | 826 |
| O15355 | 827 |
| O15379 | 828 |
| O15541 | 829 |
| O43236 | 830 |
| P00352 | 831 |
| P00367 | 832 |
| P00480 | 833 |
| P00519 | 834 |
| P00966 | 835 |
| P02261 | 836 |
| P02533 | 837 |
| P02545 | 838 |
| P02546 | 839 |
| P02812 | 840 |
| P04062 | 841 |
| P04114 | 842 |
| P04181 | 843 |
| P04264 | 844 |
| P04280 | 845 |
| P04645 | 846 |
| P04765 | 847 |
| P04901 | 848 |
| P04908 | 849 |
| P05089 | 850 |
| P05091 | 851 |
| P05092 | 852 |
| P05127 | 853 |
| P05323 | 854 |
| P05387 | 855 |
| P05412 | 856 |
| P05423 | 857 |
| P05787 | 858 |
| P06241 | 859 |
| P06468 | 860 |
| P06748 | 861 |
| P07029 | 862 |
| P07197 | 863 |
| P07199 | 864 |
| P07203 | 865 |
| P07332 | 866 |
| P07384 | 867 |
| P07585 | 868 |
| P07942 | 869 |
| P07947 | 870 |
| P07951 | 871 |
| P08047 | 872 |
| P08129 | 873 |
| P08151 | 874 |
| P08578 | 875 |
| P08621 | 876 |
| P08670 | 877 |
| P08865 | 878 |
| P08910 | 879 |
| P09058 | 880 |
| P09110 | 881 |
| P09329 | 882 |
| P09429 | 883 |
| P09651 | 884 |
| P09769 | 885 |
| P10070 | 886 |
| P10071 | 887 |
| P10161 | 888 |
| P10162 | 889 |
| P10163 | 890 |
| P10242 | 891 |
| P10243 | 892 |
| P10244 | 893 |
| P10265 | 894 |
| P10275 | 895 |
| P10451 | 896 |
| P10515 | 897 |
| P10644 | 898 |
| P11016 | 899 |
| P11047 | 900 |

TABLE 8-continued

| ACCNO | SEQIDNO |
|---|---|
| P11055 | 901 |
| P11082 | 902 |
| P11161 | 903 |
| P11177 | 904 |
| P11182 | 905 |
| P11387 | 906 |
| P11441 | 907 |
| P11766 | 908 |
| P11908 | 909 |
| P11940 | 910 |
| P12036 | 911 |
| P12079 | 912 |
| P12268 | 913 |
| P12270 | 914 |
| P12882 | 915 |
| P12883 | 916 |
| P13533 | 917 |
| P13535 | 918 |
| P13645 | 919 |
| P13667 | 920 |
| P13807 | 921 |
| P13861 | 922 |
| P13862 | 923 |
| P14061 | 924 |
| P14314 | 925 |
| P14317 | 926 |
| P14619 | 927 |
| P14635 | 928 |
| P14648 | 929 |
| P14678 | 930 |
| P15428 | 931 |
| P15498 | 932 |
| P15531 | 933 |
| P15735 | 934 |
| P15918 | 935 |
| P15924 | 936 |
| P16104 | 937 |
| P16118 | 938 |
| P16333 | 939 |
| P16520 | 940 |
| P16591 | 941 |
| P17032 | 942 |
| P17252 | 943 |
| P17480 | 944 |
| P17600 | 945 |
| P17612 | 946 |
| P17655 | 947 |
| P17661 | 948 |
| P17677 | 949 |
| P17861 | 950 |
| P17931 | 951 |
| P17980 | 952 |
| P18146 | 953 |
| P18283 | 954 |
| P18583 | 955 |
| P19174 | 956 |
| P19338 | 957 |
| P19387 | 958 |
| P19388 | 959 |
| P19544 | 960 |
| P19784 | 961 |
| P19678 | 962 |
| P20172 | 963 |
| P20226 | 964 |
| P20248 | 965 |
| P20265 | 966 |
| P20309 | 967 |
| P20585 | 968 |
| P20591 | 969 |
| P20592 | 970 |
| P20749 | 971 |
| P20807 | 972 |
| P20839 | 973 |
| P21108 | 974 |
| P21181 | 975 |
| P21439 | 976 |
| P21695 | 977 |
| P21815 | 978 |
| P21817 | 979 |
| P21851 | 980 |
| P21953 | 981 |
| P22102 | 982 |
| P22234 | 983 |
| P22307 | 984 |
| P22314 | 985 |
| P22352 | 986 |
| P22392 | 987 |
| P22570 | 988 |
| P22626 | 989 |
| P22670 | 990 |
| P22694 | 991 |
| P22792 | 992 |
| P23246 | 993 |
| P23284 | 994 |
| P23327 | 995 |
| P23443 | 996 |
| P23490 | 997 |
| P23511 | 998 |
| P23515 | 999 |
| P23567 | 1000 |
| P23769 | 1001 |
| P23771 | 1002 |
| P24723 | 1003 |
| P24752 | 1004 |
| P24928 | 1005 |
| P24941 | 1006 |
| P25054 | 1007 |
| P25208 | 1008 |
| P25388 | 1009 |
| P25763 | 1010 |
| P25786 | 1011 |
| P25787 | 1012 |
| P25788 | 1013 |
| P25789 | 1014 |
| P26196 | 1015 |
| P26358 | 1016 |
| P26378 | 1017 |
| P26583 | 1018 |
| P26651 | 1019 |
| P26885 | 1020 |
| P27361 | 1021 |
| P27448 | 1022 |
| P27797 | 1023 |
| P27824 | 1024 |
| P28001 | 1025 |
| P28160 | 1026 |
| P28370 | 1027 |
| P28482 | 1028 |
| P28676 | 1029 |
| P29084 | 1030 |
| P29144 | 1031 |
| P29354 | 1032 |
| P29375 | 1033 |
| P29475 | 1034 |
| P29558 | 1035 |
| P29590 | 1036 |
| P29591 | 1036 |
| P29592 | 1036 |
| P29593 | 1036 |
| P29973 | 1037 |
| P30041 | 1038 |
| P30048 | 1039 |
| P30153 | 1040 |
| P30260 | 1041 |
| P30405 | 1042 |
| P30414 | 1043 |
| P30622 | 1044 |
| P30626 | 1045 |
| P30793 | 1046 |
| P30837 | 1047 |
| P31146 | 1048 |
| P31321 | 1049 |
| P31323 | 1050 |
| P31327 | 1051 |

TABLE 8-continued

| ACCNO | SEQIDNO |
|---|---|
| P31689 | 1052 |
| P31749 | 1053 |
| P31751 | 1054 |
| P32119 | 1055 |
| P32320 | 1056 |
| P32322 | 1057 |
| P32780 | 1058 |
| P32929 | 1059 |
| P33176 | 1060 |
| P33240 | 1061 |
| P33316 | 1062 |
| P33551 | 1063 |
| P33908 | 1064 |
| P34062 | 1065 |
| P34991 | 1066 |
| P35222 | 1067 |
| P35226 | 1068 |
| P35227 | 1069 |
| P35228 | 1070 |
| P35241 | 1071 |
| P35249 | 1072 |
| P35250 | 1073 |
| P35251 | 1074 |
| P35520 | 1075 |
| P35555 | 1076 |
| P35579 | 1077 |
| P35580 | 1078 |
| P35606 | 1079 |
| P35637 | 1080 |
| P35658 | 1081 |
| P35659 | 1082 |
| P35663 | 1083 |
| P35749 | 1084 |
| P35754 | 1085 |
| P35813 | 1086 |
| P35858 | 1087 |
| P35998 | 1088 |
| P36402 | 1089 |
| P36551 | 1090 |
| P36776 | 1091 |
| P36777 | 1092 |
| P36873 | 1093 |
| P36969 | 1094 |
| P37140 | 1095 |
| P37198 | 1096 |
| P38159 | 1097 |
| P38398 | 1098 |
| P38919 | 1099 |
| P38935 | 1100 |
| P39687 | 1101 |
| P39880 | 1102 |
| P40937 | 1103 |
| P41182 | 1104 |
| P41223 | 1105 |
| P41226 | 1106 |
| P41240 | 1107 |
| P41567 | 1108 |
| P42024 | 1109 |
| P42025 | 1110 |
| P42336 | 1111 |
| P42345 | 1112 |
| P42566 | 1113 |
| P42568 | 1114 |
| P42655 | 1115 |
| P42765 | 1116 |
| P42773 | 1117 |
| P42858 | 1118 |
| P43034 | 1119 |
| P43246 | 1120 |
| P43487 | 1121 |
| P43686 | 1122 |
| P43694 | 1123 |
| P45379 | 1124 |
| P45844 | 1125 |
| P45877 | 1126 |
| P45974 | 1127 |
| P45984 | 1128 |
| P45985 | 1129 |
| P46060 | 1130 |
| P46100 | 1131 |
| P46108 | 1132 |
| P46109 | 1133 |
| P46734 | 1134 |
| P46821 | 1135 |
| P46939 | 1136 |
| P46976 | 1137 |
| P47210 | 1138 |
| P47895 | 1139 |
| P47974 | 1140 |
| P47986 | 1141 |
| P48634 | 1142 |
| P48681 | 1143 |
| P48729 | 1144 |
| P48730 | 1145 |
| P49137 | 1146 |
| P49189 | 1147 |
| P49321 | 1148 |
| P49354 | 1149 |
| P49356 | 1150 |
| P49368 | 1151 |
| P49418 | 1152 |
| P49448 | 1153 |
| P49454 | 1154 |
| P49459 | 1155 |
| P49593 | 1156 |
| P49674 | 1157 |
| P49736 | 1158 |
| P49770 | 1159 |
| P49790 | 1160 |
| P49792 | 1161 |
| P49840 | 1162 |
| P49841 | 1163 |
| P49848 | 1164 |
| P49959 | 1165 |
| P50502 | 1166 |
| P50550 | 1167 |
| P50570 | 1168 |
| P50613 | 1169 |
| P51451 | 1170 |
| P51531 | 1171 |
| P51532 | 1172 |
| P51649 | 1173 |
| P51668 | 1174 |
| P51669 | 1175 |
| P51784 | 1176 |
| P51786 | 1177 |
| P51812 | 1178 |
| P51825 | 1179 |
| P51854 | 1180 |
| P51955 | 1181 |
| P51956 | 1182 |
| P51957 | 1183 |
| P51965 | 1184 |
| P52292 | 1185 |
| P52294 | 1186 |
| P52564 | 1187 |
| P52565 | 1188 |
| P52566 | 1189 |
| P52569 | 1190 |
| P52655 | 1191 |
| P52701 | 1192 |
| P52736 | 1193 |
| P52740 | 1194 |
| P52742 | 1195 |
| P52745 | 1386 |
| P52756 | 1196 |
| P52948 | 1197 |
| P53355 | 1198 |
| P53609 | 1199 |
| P53621 | 1200 |
| P53677 | 1201 |
| P53680 | 1202 |
| P53778 | 1203 |
| P53779 | 1204 |

TABLE 8-continued

| ACCNO | SEQIDNO |
|---|---|
| P53803 | 1205 |
| P54136 | 1206 |
| P54252 | 1207 |
| P54253 | 1208 |
| P54259 | 1209 |
| P54578 | 1210 |
| P54619 | 1211 |
| P54646 | 1212 |
| P54725 | 1213 |
| P54727 | 1214 |
| P54840 | 1215 |
| P55081 | 1216 |
| P55084 | 1217 |
| P55209 | 1218 |
| P55273 | 1219 |
| P55854 | 1220 |
| P55855 | 1221 |
| P56524 | 1222 |
| P56545 | 1223 |
| P56554 | 1224 |
| P78368 | 1225 |
| P78406 | 1226 |
| P78540 | 1227 |
| P80095 | 1228 |
| P80303 | 1229 |
| P98171 | 1230 |
| P98174 | 1231 |
| P98175 | 1232 |
| P98179 | 1233 |
| Q00059 | 1234 |
| Q00341 | 1235 |
| Q00526 | 1236 |
| Q00534 | 1237 |
| Q00535 | 1238 |
| Q00536 | 1239 |
| Q00688 | 1240 |
| Q00755 | 1036 |
| Q00796 | 1241 |
| Q00839 | 1242 |
| Q01082 | 1243 |
| Q01085 | 1244 |
| Q01105 | 1245 |
| Q01484 | 1246 |
| Q01485 | 1246 |
| Q01534 | 1247 |
| Q01658 | 1248 |
| Q01826 | 1249 |
| Q01844 | 1250 |
| Q02078 | 1251 |
| Q02224 | 1252 |
| Q02338 | 1253 |
| Q02446 | 1254 |
| Q02505 | 1255 |
| Q02547 | 1256 |
| Q02750 | 1257 |
| Q02817 | 1258 |
| Q02832 | 1259 |
| Q03001 | 1260 |
| Q03111 | 1261 |
| Q03164 | 1262 |
| Q03468 | 1263 |
| Q03527 | 1264 |
| Q04724 | 1265 |
| Q04759 | 1266 |
| Q05048 | 1267 |
| Q05193 | 1268 |
| Q05215 | 1269 |
| Q05516 | 1270 |
| Q05682 | 1271 |
| Q06481 | 1272 |
| Q06547 | 1273 |
| Q06609 | 1274 |
| Q06722 | 1387 |
| Q06730 | 1275 |
| Q06828 | 1276 |
| Q06830 | 1277 |
| Q06889 | 1278 |
| Q06945 | 1279 |
| Q07283 | 1280 |
| Q07352 | 1281 |
| Q08170 | 1282 |
| Q08209 | 1283 |
| Q08378 | 1284 |
| Q08379 | 1285 |
| Q08752 | 1286 |
| Q08945 | 1287 |
| Q09028 | 1288 |
| Q09472 | 1289 |
| Q10567 | 1290 |
| Q10571 | 1291 |
| Q12788 | 1292 |
| Q12840 | 1293 |
| Q12962 | 1294 |
| Q13098 | 1295 |
| Q13131 | 1296 |
| Q13153 | 1297 |
| Q13162 | 1298 |
| Q13163 | 1299 |
| Q13164 | 1300 |
| Q13177 | 1301 |
| Q13190 | 1302 |
| Q13216 | 1303 |
| Q13360 | 1304 |
| Q13363 | 1305 |
| Q13416 | 1306 |
| Q13438 | 1307 |
| Q13547 | 1308 |
| Q13573 | 1309 |
| Q13608 | 1310 |
| Q13610 | 1311 |
| Q13813 | 1312 |
| Q13838 | 1313 |
| Q14012 | 1314 |
| Q14028 | 1315 |
| Q14093 | 1316 |
| Q14141 | 1317 |
| Q14154 | 1318 |
| Q14156 | 1319 |
| Q14157 | 1320 |
| Q14203 | 1321 |
| Q14232 | 1322 |
| Q14240 | 1323 |
| Q14247 | 1324 |
| Q14392 | 1325 |
| Q14565 | 1326 |
| Q14669 | 1327 |
| Q14687 | 1328 |
| Q14690 | 1329 |
| Q14814 | 1330 |
| Q15019 | 1331 |
| Q15032 | 1332 |
| Q15036 | 1333 |
| Q15072 | 1334 |
| Q15181 | 1335 |
| Q15269 | 1336 |
| Q15274 | 1337 |
| Q15427 | 1338 |
| Q15431 | 1339 |
| Q15436 | 1340 |
| Q15437 | 1341 |
| Q15542 | 1342 |
| Q15544 | 1343 |
| Q15545 | 1344 |
| O15696 | 1345 |
| Q15759 | 1346 |
| Q15811 | 1347 |
| Q15831 | 1348 |
| Q16134 | 1349 |
| Q16181 | 1350 |
| Q16281 | 1351 |
| Q16539 | 1352 |
| Q16566 | 1353 |
| Q16576 | 1354 |
| Q16594 | 1355 |

TABLE 8-continued

| ACCNO | SEQIDNO |
|---|---|
| Q16600 | 1356 |
| Q16643 | 1357 |
| Q16781 | 1358 |
| Q16787 | 1359 |
| Q16816 | 1360 |
| Q16875 | 1361 |
| Q16877 | 1362 |
| Q92524 | 1363 |
| Q92636 | 1364 |
| Q92696 | 1365 |
| Q92764 | 1366 |
| Q92769 | 1367 |
| Q92781 | 1368 |
| Q92785 | 1369 |
| Q92793 | 1370 |
| Q92794 | 1371 |
| Q92908 | 1372 |
| Q92995 | 1373 |
| Q93008 | 1374 |
| Q93009 | 1375 |
| Q93068 | 1376 |
| Q93074 | 1377 |
| Q99102 | 1378 |
| Q99217 | 1379 |
| Q99418 | 1380 |
| Q99457 | 1381 |
| Q99462 | 1382 |
| Q99471 | 1383 |
| Q99733 | 1384 |
| Q99759 | 1385 |

In certain embodiments, one of the ortholog polypeptides includes a "bait" polypeptide selected from the polypeptides recited in Table 7, column 2, and the other ortholog polypeptide includes a "prey" protein selected from the polypeptides recited in Table 7, column 6. The yeast orthologs of these proteins are set out in columns 1 and 4 of Table 7, respectively. In some embodiments the first and second polypeptides of the complex are the polypeptides enumerated in Table 7. In some embodiments a first polypeptide is a "bait" polypeptide and a second polypeptide is "target" polypeptide, while in other embodiments the first polypeptide is a "target" polypeptide and the second is a "bait" polypeptide. Conservative variants of either polypeptide which retain binding specificity are within the scope of the invention, as are labeled forms of the complexes, as described above.

In other embodiments, the polypeptides are the binding domains of the "bait" and "prey" polypeptides listed in Table 7. A binding domain of a given first polypeptide may be any number of amino acids sufficient to specifically bind to, and complex with, the corresponding second polypeptide under conditions suitable for complex formation. A binding domain may be the minimal number of amino acids required to retain binding affinity, or may be a larger fragment or derivative of the polypeptides listed in Table 7, columns 2 and 6.

In certain embodiments, the "bait" polypeptides of the ortholog complex are polypeptides categorized, for example, as a "Metabolism" protein in the MIPS database. In some embodiments, the "prey" protein of the complex is also a "Metabolism" protein, while in other embodiments the "prey" protein is, for example, an "Unclassified" protein (see Table 7). Other exemplary MIPS categories include, e.g., "Cell Growth/Cell Division/DNA Synthesis" proteins (see Table 2).

In a further aspect, the invention provides chimeric polypeptide complex that includes at least one yeast polypeptide and at least one human ortholog of the corresponding interacting yeast polypeptide. In one embodiment, there is provided a purified chimeric complex including a yeast "bait" polypeptide selected from the polypeptides recited in Table 7, column 1 and a human ortholog of the corresponding yeast "prey" polypeptide; the human ortholog is selected from the polypeptides recited in Table 7, column 6 (while the corresponding yeast "prey" proteins are recited in column 5). For example, with reference to Table 7, first row, in one embodiment, a chimeric protein containing YAL032C and P16118 is provided (P16118 is the human ortholog of corresponding yeast "prey" protein YLR345W).

In other embodiments, the complex contains a human ortholog of a yeast "bait" protein and a yeast "prey" protein. The yeast "prey" protein is selected from the polypeptides recited in Table 7, column 5, and the human ortholog of the corresponding yeast "bait" protein is selected from the polypeptides recited in Table 7, column 2 (while the corresponding yeast "bait" proteins themselves are recited in column 1). For example, with reference to Table 7, first row, in one embodiment, a chimeric protein containing Q13573 and YLR345W is provided (Q13573 is the human ortholog of corresponding yeast "bait" protein YAL032C).

In certain embodiments the first and second polypeptides of the chimeric complex are the polypeptides recited in Table 7, columns 1 and 6, or columns 2 and 5, respectively, while in other embodiments, the polypeptides of the chimeric complex contain the polypeptides recited in Table 7. Conservative variants of either polypeptide which retain binding specificity are within the scope of the invention, as are labeled forms of the chimeric complexes, and chimeric complexes of binding domains, as described above.

Chimeric Polypeptides, DNA, Vectors and Recombinant Cells

In a further aspect, the invention provides a chimeric polypeptide that includes sequences of two interacting proteins according to the invention. The interacting proteins can be, e.g., the interacting protein pairs disclosed in Tables 3–7, herein. Also included are chimeric polypeptides including multimers, i.e., sequences from two or more pairs of interacting proteins. An example of such a chimeric polypeptide is a polypeptide that includes amino acid sequences from ProPair 1a and 1b, and from ProPair 2a and 2b. The chimeric polypeptide includes a region of a first protein covalently linked, e.g. via peptide bond, to a region of a second protein. In certain embodiments, the second protein is a species ortholog of the first protein. In some embodiments, the chimeric polypeptide contains regions of first and second proteins from yeast, where the proteins are selected from the "bait" and corresponding "prey" proteins recited in Table 3, columns 1 and 4, respectively. In other embodiments, the chimeric polypeptide contains regions of first and second human ortholog proteins, where the proteins are selected from the "bait" and corresponding "prey" proteins recited in Table 7, columns 2 and 6, respectively (the yeast orthologs of these proteins are recited in columns 1 and 5, respectively). In still other embodiments, the chimeric polypeptide contains regions of a first protein from yeast, and a second human ortholog protein, where the yeast proteins are selected from the "bait" and corresponding "prey" proteins recited in Table 7, columns 1 and 5, respectively, while the human ortholog proteins are selected from the "bait" and corresponding "prey" proteins recited in Table 7, columns 2 and 6, respectively.

In some embodiments, the chimeric polypeptide(s) of the complex include(s) six or more amino acids of a first protein covalently linked to six or more amino acids of a second protein. In other embodiments, the chimeric polypeptide includes at least one binding domain of a first or second protein.

Preferably, the chimeric polypeptide includes a region of amino acids of the first polypeptide able to bind to a second polypeptide. Alternatively, or in addition, the chimeric polypeptide includes a region of amino acids of the second polypeptide able to bind to the first polypeptide.

Nucleic acid encoding the chimeric polypeptide, as well as vectors and cells containing these nucleic acids, are within the scope of the present invention. The chimeric polypeptides can be constructed by expressing nucleic acids encoding chimeric polypeptides using recombinant methods, described above, then recovering the chimeric polypeptides, or by chemically synthesizing the chimeric polypeptides. Host-vector systems that can be used to express chimeric polypeptides include, e.g.: (i) mammalian cell systems which are infected with vaccinia virus, adenovirus; (ii) insect cell systems infected with baculovirus; (iii) yeast containing yeast vectors or (iv) bacteria transformed with bacteriophage, DNA, plasmid DNA, or cosmid DNA. Depending upon the host-vector system utilized, any one of a number of suitable transcription and translation elements may be used.

The expression of the specific proteins may be controlled by any promoter/enhancer known in the art including, e.g.: (i) the SV40 early promoter (see e.g., Bernoist & Chambon, *Nature* 290: 304–310 (1981)); (ii) the promoter contained within the 3'-terminus long terminal repeat of Rous Sarcoma Virus (see e.g., Yamamoto, et al., *Cell* 22: 787–797 (1980)); (iii) the Herpesvirus thymidine kinase promoter (see e.g., Wagner, et al., *Proc. Natl. Acad. Sci. USA* 78: 1441–1445 (1981)); (iv) the regulatory sequences of the metallothionein gene (see e.g., Brinster, et al., *Nature* 296: 39–42 (1982)); (v) prokaryotic expression vectors such as the β-lactamase promoter (see e.g., Villa-Kamaroff, et al., *Proc. Natl. Acad. Sci. USA* 75: 3727–3731 (1978)); (vi) the tac promoter (see e.g., DeBoer, et al., *Proc. Natl. Acad. Sci. USA* 80: 21–25 (1983)).

Plant promoter/enhancer sequences within plant expression vectors may also be utilized including, e.g.,: (i) the nopaline synthetase promoter (see e.g., Herrar-Estrella, et al., *Nature* 303: 209–213 (1984)); (ii) the cauliflower mosaic virus 35S RNA promoter (see e.g., Garder, et al., *Nuc. Acids Res.* 9: 2871 (1981)) and (iii) the promoter of the photosynthetic enzyme ribulose bisphosphate carboxylase (see e.g., Herrera-Estrella, et al., *Nature* 310: 115–120 (1984)).

Promoter/enhancer elements from yeast and other fungi (e.g., the Gal4 promoter, the alcohol dehydrogenase promoter, the phosphoglycerol kinase promoter, the alkaline phosphatase promoter), as well as the following animal transcriptional control regions, which possess tissue specificity and have been used in transgenic animals, may be utilized in the production of proteins of the present invention.

Other animal transcriptional control sequences derived from animals include, e.g.,: (i) the insulin gene control region active within pancreatic β-cells (see e.g., Hanahan, et al., *Nature* 315: 115–122 (1985)); (ii) the immunoglobulin gene control region active within lymphoid cells (see e.g., Grosschedl, et al., *Cell* 38: 647–658 (1984)); (iii) the albumin gene control region active within liver (see e.g., Pinckert, et al., *Genes and Devel.* 1: 268–276 (1987)); (iv) the myelin basic protein gene control region active within brain oligodendrocyte cells (see e.g., Readhead, et al., *Cell* 48: 703–712 (1987)); and (v) the gonadotrophin-releasing hormone gene control region active within the hypothalamus (see e.g., Mason, et al., *Science* 234: 1372–1378 (1986)).

The vector may include a promoter operably-linked to nucleic acid sequences which encode a chimeric polypeptide, one or more origins of replication, and optionally, one or more selectable markers (e.g., an antibiotic resistance gene). A host cell strain may be selected which modulates the expression of chimeric sequences, or modifies/processes the expressed proteins in a desired manner. Moreover, different host cells possess characteristic and specific mechanisms for the translational and post-translational processing and modification (e.g., glycosylation, phosphorylation, and the like) of expressed proteins. Appropriate cell lines or host systems may thus be chosen to ensure the desired modification and processing of the foreign protein is achieved. For example, protein expression within a bacterial system can be used to produce an unglycosylated core protein; whereas expression within mammalian cells ensures "native" glycosylation of a heterologous protein.

Antibodies Specific for Polypeptide Complexes

The invention further provides antibodies and antibody fragments (such as Fab or (Fab)2 fragments) that bind specifically to the complexes described herein. By "specifically binds" is meant an antibody that recognizes and binds to a particular polypeptide complex of the invention, but which does not substantially recognize or bind to other molecules in a sample, or to any of the polypeptides of the complex when those polypeptides are not complexed.

For example, a purified complex, or a portion, variant, or fragment thereof, can be used as an immunogen to generate antibodies that specifically bind the complex using standard techniques for polyclonal and monoclonal antibody preparation.

A full-length polypeptide complex can be used, if desired. Alternatively, the invention provides antigenic fragments of polypeptide complexes for use as immunogens. In some embodiments, the antigenic complex fragment includes at least 6, 8, 10, 15, 20, or 30 or more amino acid residues of a polypeptide. In one embodiment, epitopes encompassed by the antigenic peptide include the binding domains of the polypeptides, or are located on the surface of the protein, e.g., hydrophilic regions.

If desired, peptides containing antigenic regions can be selected using hydropathy plots showing regions of hydrophilicity and hydrophobicity. These plots may be generated by any method well known in the art, including, for example, the Kyte Doolittle or the Hopp Woods methods, either with or without Fourier transformation. See, e.g., Hopp and Woods, *Proc. Nat. Acad. Sci. USA* 78:3824–3828 (1981); Kyte and Doolittle, *J. Mol. Biol.* 157:105–142 (1982).

The term "antibody" as used herein refers to immunoglobulin molecules and immunologically active portions of immunoglobulin molecules, i.e., molecules that contain an antigen binding site that specifically binds (immunoreacts with) an antigen, such as a polypeptide complex. Such antibodies include, e.g.,polyclonal, monoclonal, chimeric, single chain, Fab and F(ab')2 fragments, and an Fab expression library. In specific embodiments, antibodies to human ortholog complexes.

Various procedures known within the art may be used for the production of polyclonal or monoclonal antibodies. For example, for the production of polyclonal antibodies, various suitable host animals (e.g., rabbit, goat, mouse or other mammal) may be immunized by injection with the native protein, or a synthetic variant thereof, or a derivative of the foregoing. An appropriate immunogenic preparation can contain, for example, recombinantly expressed polypeptide complex. Alternatively, the immunogenic polypeptides or complex may be chemically synthesized, as discussed above. The preparation can further include an adjuvant. Various adjuvants used to increase the immunological response include, e.g., Freund's (complete and incomplete), mineral gels (e.g., aluminum hydroxide), surface active substances (e.g., lysolecithin, pluronic polyols, polyanions, peptides, oil emulsions, dinitrophenol, etc.), human adjuvants such as Bacille Calmette-Guerin and *Corynebacterium parvum*, or similar immunostimulatory agents. If desired, the antibody molecules directed against complex can be isolated from the mammal (e.g., from the blood) and further purified by well known techniques, such as protein A chromatography to obtain the IgG fraction.

The term "monoclonal antibody" or "monoclonal antibody composition", as used herein, refers to a population of antibody molecules that contain only one species of an antigen binding site capable of immunoreacting with a particular epitope of a polypeptide complex. A monoclonal antibody composition thus typically displays a single binding affinity for a particular protein with which it immunoreacts. For preparation of monoclonal antibodies directed towards a particular complex, or polypeptide, any technique that provides for the production of antibody molecules by continuous cell line culture may be utilized. Such techniques include, e.g., the hybridoma technique (see Kohler & Milstein, *Nature* 256: 495–497 (1975)); the trioma technique; the human B-cell hybridoma technique (see Kozbor, et al., *Immunol Today* 4: 72 (1983)); and the EBV hybridoma technique to produce human monoclonal antibodies (see Cole, et al., In: *Monoclonal Antibodies and Cancer Therapy*, Alan R. Liss, Inc., (1985) pp. 77–96). If desired, human monoclonal antibodies may be prepared by using human hybridomas (see Cote, et al., *Proc. Natl. Acad. Sci. USA* 80: 2026–2030 (1983)) or by transforming human B-cells with Epstein Barr Virus in vitro (see Cole, et al., In: *Monoclonal Antibodies and Cancer Therapy*, supra).

Methods can be adapted for the construction of $F_{ab}$ expression libraries (see e.g., Huse, et al., *Science* 246: 1275–1281 (1989)) to allow rapid and effective identification of monoclonal $F_{ab}$ fragments with the desired specificity for the desired protein or derivatives, fragments, analogs or homologs thereof. Non-human antibodies can be "humanized" by techniques well known in the art. See e.g., U.S. Pat. No. 5,225,539. Antibody fragments that contain the idiotypes to a polypeptide or polypeptide complex may be produced by techniques known in the art including, e.g.: (i) an $F_{(ab')2}$ fragment produced by pepsin digestion of an antibody molecule; (ii) an $F_{ab}$ fragment generated by reducing the disulfide bridges of an $F_{(ab')2}$ fragment; (iii) an $F_{ab}$ fragment generated by the treatment of the antibody molecule with papain and a reducing agent and (iv) $F_v$ fragments.

Chimeric and humanized monoclonal antibodies against the polypeptide complexes, or polypeptides, described herein are also within the scope of the invention, and can be produced by recombinant DNA techniques known in the art, for example using methods described in PCT International Application No. PCT/US86/02269; European Patent Application No. 184,187; European Patent Application No. 171,496; European Patent Application No. 173,494; PCT International Publication No. WO 86/01533; U.S. Pat. No. 4,816,567; European Patent Application No. 125,023; Better et al., *Science* 240: 1041–1043 (1988); Liu et al., *Proc. Nat. Acad. Sci. USA* 84: 3439–3443 (1987); Liu et al., *J. Immunol.* 139: 3521–3526 (1987); Sun et al., *Proc. Nat. Acad. Sci. USA* 84: 214–218 (1987); Nishimura et al., *Cancer Res.* 47: 999–1005 (1987); Wood et al., *Nature* 314: 446–449 (1985); Shaw et al., *J. Natl. Cancer Inst.* 80: 1553–1559 (1988); Morrison, *Science* 229: 1202–1207 (1985); Oi et al., *BioTechniques* 4: 214 (1986); U.S. Pat. No. 5,225,539; Jones et al., *Nature* 321: 552–525 (1986); Verhoeyan et al., *Science* 239: 1534 (1988); and Beidler et al., *J. Immunol.* 141: 4053–4060 (1988).

Methods for the screening of antibodies that possess the desired specificity include, e.g., enzyme-linked immunosorbent assay (ELISA) and other immunologically-mediated techniques known within the art. For example, selection of antibodies that are specific to a particular domain of a polypeptide complex is facilitated by generation of hybridomas that bind to the complex, or fragment thereof, possessing such a domain.

In certain embodiments of the invention, antibodies specific for the polypeptide complexes described herein may be used in various methods, such as detection of complex, and identification of agents which disrupt complexes. These methods are described in more detail, below. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^3H$.

Polypeptide complex-specific, or polypeptide-specific antibodies, can also be used to isolate complexes using standard techniques, such as affinity chromatography or immunoprecipitation. Thus, the antibodies disclosed herein can facilitate the purification of specific polypeptide complexes from cells, as well as recombinantly produced complexes expressed in host cells.

Kits

In a specific embodiment, the invention provides kits containing a reagent, for example, an antibody described above, which can specifically detect a polypeptide complex, or a constituent polypeptide, described herein. Such kits can contain, for example, reaction vessels, reagents for detecting complex in sample, and reagents for development of detected complex, e.g. a secondary antibody coupled to a detectable marker. The label incorporated into the anti-complex, or anti-polypeptide antibody may include, e.g., a chemiluminescent, enzymatic, fluorescent, colorimetric or radioactive moiety. Kits of the present invention may be employed in diagnostic and/or clinical screening assays.

Pharmaceutical Compositions

The invention further provides pharmaceutical compositions of purified complexes suitable for administration to a subject, most preferably, a human, in the treatment of disorders involving altered levels of such complexes. Such preparations include a therapeutically-effective amount of a complex, and a pharmaceutically acceptable carrier. As utilized herein, the term "pharmaceutically acceptable" means approved by a regulatory agency of the Federal or a state government or listed in the U.S. Pharmacopoeia or other generally recognized pharmacopoeia for use in animals and, more particularly, in humans. The term "carrier" refers to a diluent, adjuvant, excipient, or vehicle with which the therapeutic is administered and includes, but is not limited to such sterile liquids as water and oils.

The therapeutic amount of a complex which will be effective in the treatment of a particular disorder or condition will depend on the nature of the disorder or condition, and may be determined by standard clinical techniques by those of average skill within the art. In addition, in vitro assays may optionally be employed to help identify optimal dosage ranges. The precise dose to be employed in the formulation will also depend on the route of administration, and the overall seriousness of the disease or disorder, and should be decided according to the judgment of the practitioner and each patient's circumstances. [[However, suitable dosage ranges for intravenous administration of the complexes of the present invention are generally about 20–500 micrograms ($\mu$g) of active compound per kilogram (Kg) body weight. Suitable dosage ranges for intranasal administration are generally about 0.01 pg/kg body weight to 1 mg/kg body weight. Effective doses may be extrapolated from dose-response curves derived from in vitro or animal model test systems. Suppositories generally contain active ingredient in the range of 0.5% to 10% by weight; oral formulations preferably contain 10% to 95% active ingredient.

Various delivery systems are known and can be used to administer a pharmaceutical preparation of a complex of the invention including, e.g.: (i) encapsulation in liposomes, microparticles, microcapsules; (ii) recombinant cells capable of expressing the polypeptides of the complex; (iii) receptor-mediated endocytosis (see, e.g., Wu et al., *J. Biol. Chem.* 262: 4429–4432 (1987)); (iv) construction of a nucleic acid encoding the polypeptides of the complex as part of a retroviral or other vector, and the like.

Methods of administration include, e.g., intradermal, intramuscular, intraperitoneal, intravenous, subcutaneous, intranasal, epidural, and oral routes. The pharmaceutical preparations of the present invention may be administered by any convenient route, for example by infusion or bolus injection, by absorption through epithelial or mucocutaneous linings (e.g., oral mucosa, rectal and intestinal mucosa, etc.) and may be administered together with other biologically-active agents. Administration can be systemic or local. In addition, it may be advantageous to administer the pharmaceutical preparation into the central nervous system by any suitable route, including intraventricular and intrathecal injection. Intraventricular injection may be facilitated by an intraventricular catheter attached to a reservoir (e.g., an Ommaya reservoir). Pulmonary administration may also be employed by use of an inhaler or nebulizer, and formulation with an aerosolizing agent. It may also be desirable to administer the pharmaceutical preparation locally to the area in need of treatment; this may be achieved by, for example, and not by way of limitation, local infusion during surgery, topical application, by injection, by means of a catheter, by means of a suppository, or by means of an implant. In a specific embodiment, administration may be by direct injection at the site (or former site) of a malignant tumor or neoplastic or pre-neoplastic tissue.

Alternatively, pharmaceutical preparations of the invention may be delivered in a vesicle, in particular a liposome, (see, e.g., Langer, *Science* 249:1527–1533 (1990)) or via a controlled release system including, e.g., a delivery pump (see, e.g., Saudek, et al., *New Engl. J. Med.* 321: 574 (1989) and a semi-permeable polymeric material (see, e.g., Howard, et al., *J. Neurosurg.* 71: 105 (1989)). Additionally, the controlled release system can be placed in proximity of the therapeutic target (e.g., the brain), thus requiring only a fraction of the systemic dose. See, e.g., Goodson, In: *Medical Applications of Controlled Release*, 1984 (CRC Press, Bocca Raton, Fla.).

Screening, Diagnostic, and Therapeutic Methods

The invention further provides methods of identifying an agent which modulate formation or stability a polypeptide complex described herein. By modulate is meant to increase or decrease the rate at which the complex is assembled or dissembled, or to increase or decrease the stability of an assembled complex. Thus, an agent can be tested for its ability to disrupt a complex, or to promote formation or stability of a complex.

In one embodiment, the invention provides a method of identifying an agent that promotes disruption of a complex. The method includes providing a polypeptide complex, contacting the complex with a test agent, and detecting the presence of a polypeptide displaced from the complex. The presence of displaced polypeptide indicates the disruption of the complex by the agent. In some embodiments, the complex is a human ortholog complex, as described above, which includes "bait" and "prey" proteins selected from those recited in Table 7. In other embodiments, the complex contains at least one microtubule or microtubule-associated protein, as described above, and is selected from the complexes recited in Table 4. In other embodiments, the complex contains at least one heme biosynthesis protein, as described above, and is the complex recited in Table 5. In yet another embodiment, the complex contains at least one cell wall or cell wall-synthesis protein, as described above, and is selected from the complexes recited in Table 6. Agents which disrupt complexes of the invention may present novel modulators of cell processes and pathways in which the complexes participate. For example, agents which disrupt complexes involving microtubule proteins may be selected as potential anti-fungal therapeutics.

Any compound or other molecule (or mixture or aggregate thereof) can be used as a test agent. In some embodiments, the agent can be a small peptide, or other small molecule produced by e.g., combinatorial synthetic methods known in the art. Disruption of the complex by the test agent, e.g. binding of the agent to the complex, can be determined using art recognized methods, e.g., detection of polypeptide using polypeptide-specific antibodies, as described above. Bound agents can alternatively be identified by comparing the relative electrophoretic mobility of complexes exposed to the test agent to the mobility of complexes that have not been exposed to the test agent.

Agents identified in the screening assays can be further tested for their ability to alter and/or modulate cellular functions, particularly those functions in which the complex has been implicated. These functions include, e.g., control of cell-cycle progression; regulation of transcription; control of intracellular signal transduction, etc., as described in detail above.

In another embodiment, the invention provides methods for inhibiting the interaction of a polypeptide with a ligand, by contacting a complex of the protein and the ligand with an agent that disrupts the complex, as described above. In certain embodiments, the polypeptides are microtubule or microtubule-associated proteins, heme biosynthesis proteins, or cell wall or cell wall-synthesis proteins. In certain embodiments, the ligand is an interacting polypeptide, and the polypeptide and ligands are selected from those recited in Tables 4–6. Inhibition of complex formation allows for modulation of cellular functions and pathways in which the targeted complexes participate.

In another embodiment, the invention provides a method for identifying a polypeptide complex in a subject. The method includes the steps of providing a biological sample from the subject, detecting, if present, the level of polypeptide complex. In some embodiments, the complex includes a first polypeptide (a "bait" polypeptide) selected from the polypeptides recited in Table 7, column 2, and a second polypeptide ("prey" polypeptide) selected from the polypeptides recited in Table 7, column 6. Any suitable biological sample potentially containing the complex may be employed, e.g. blood, urine, cerebral-spinal fluid, plasma, etc. Complexes may be detected by, e.g., using complex-specific antibodies as described above. The method provides for diagnostic screening, including in the clinical setting, using, e.g., the kits described above.

In still another embodiment, the present invention provides methods for detecting a polypeptide in a biological sample, by providing a biological sample containing the polypeptide, contacting the sample with a corresponding polypeptide to form a complex under suitable conditions, and detecting the presence of the complex. A complex will form if the sample does, indeed, contain the first polypeptide. In some embodiments, the polypeptide being detecting is a "prey" protein selected from the polypeptides recited in Table 7, column 6, and is detected by complexing with the corresponding "bait" protein recited in Table 7, column 2. Conversely, in other embodiments the polypeptide being detected is the "bait" protein. Alternatively, a yeast "bait" or "prey" ortholog may be employed to form a chimeric complex with the polypeptide in the biological sample.

In still another embodiment, the invention provides methods for removing a first polypeptide from a biological sample by contacting the biological sample with the corresponding second peptide to form a complex under conditions suitable for such formation. The complex is then removed from the sample, effectively removing the first polypeptide. As with the methods of detecting polypeptide described above, the polypeptide being removed may be either a "bait" or "prey" protein, and the second corresponding polypeptide used to remove it may be either a yeast or human ortholog polypeptide.

Methods of determining altered expression of a polypeptide in a subject, e.g. for diagnostic purposes, are also provided by the invention. Altered expression of proteins involved in cell processes and pathways can lead to deleterious effects in the subject. Altered expression of a polypeptide in a given pathway leads to altered formation of complexes which include the polypeptide, hence providing a means for indirect detection of the polypeptide level. The method involves providing a biological sample from a subject, measuring the level of a polypeptide complex of the invention in the sample, and comparing the level to the level of complex in a reference sample having known polypeptide expression. A higher or lower complex level in the sample versus the reference indicates altered expression of either of the polypeptides that forms the complex. The detection of altered expression of a polypeptide can be use to diagnose a given disease state, and or used to identify a subject with a predisposition for a disease state. Any suitable reference sample may be employed, but preferably the test sample and the reference sample are derived from the same medium, e.g. both are urine, etc. The reference sample should be suitably representative of the level polypeptide expressed in a control population.

In a certain embodiment, the polypeptide complex contains a "bait" polypeptide selected from the polypeptides recited in Table 7, column 2, and a "prey" polypeptide selected from the polypeptides recited in Table 7, column 6.

The invention further provides methods for treating or preventing a disease or disorder involving altered levels of a polypeptide complex, or polypeptide, disclosed herein, by administering to a subject a therapeutically-effective amount of at least one molecule that modulates the function of the complex. As discussed above, altered levels of polypeptide complexes described herein may be implicated in disease states resulting from a deviation in normal function of the pathway in which a complex is implicated. For example, altered levels of the observed complex between YGR010Wp and YLR328Wp may be implicated in disruptions in arginine metabolism, leading to retinal atrophy, for example. In subjects with a deleteriously high level of complex, modulation may consist, for example, by administering an agent which disrupts the complex, or an agent which does not disrupt, but down-regulates, the functional activity of the complex. Alternatively, modulation in subjects with a deleteriously low level of complex may be achieved by pharmaceutical administration of complex, constituent polypeptide, or an agent which up-regulates the functional activity of complex. Pharmaceutical preparations suitable for administration of complex are described above.

In one embodiment, a disease or disorder involving altered levels of a polypeptide selected from the polypeptides recited in Table 7, column 2 or the corresponding polypeptides in column 4, is treated by administering a molecule that modulates the function of the polypeptide. In certain embodiments, the modulating molecule is the corresponding polypeptide, e.g. administering a "prey" protein corresponding to a "bait" protein modulates the latter by forming a complex with it.

The details of one or more embodiments of the invention are set forth in the description above. Although any methods and materials similar or equivalent to those described herein can be used in the practice of the present invention, the preferred methods and materials are now described. For example, additional interactions can be identified using other two-hybrid systems (i.e. using a LexA binding domain fusion or HIS3 as a reporter gene), including variables such as different protein domains or genomic activation domain libraries. Other features, objects, and advantages of the invention will be apparent from the description and from the claims.

The following examples are presented in order to more fully illustrate the preferred embodiments of the invention. These examples should in no way be construed as limiting the scope of the invention, as defined by the appended claims.

EXAMPLE 1

Cloning of S. Cerevisiae Open-reading Frames 6144 potential yeast open-reading frames (ORFs) have been previously described. See Goffeau et al., supra. These ORFs were amplified by PCR as full-length fragments, and each fragment was fused to sequences encoding the Gal4 DNA binding domain and the Gal4 activation domain by gap-repair cloning into the vectors pOBD2 and pOAD. PCR amplified products of the 6144 yeast ORFs were made by amplification of yeast cDNA using 70 oligonucleotide primers to allow recombination with centromeric plasmids pOBD2 and pOAD. See Hudson et al., Genome Res 7: 1169 (1997). The yeast strains used were YULH (MATa ura3-52 trp1 lys2 his3 leu2 gal4 gal80 GAL1-URA3 GAL1-LacZ) for the Gal4 binding domain fusion in pOBD2 and N106r (MATα ura3-52 his3 ade2 trp1 leu2 gal4 gal80 cyh2 lys2::GAL1-HIS3 ura3::GAL1-LacZ) for the Gal4 AD fusion in pOAD. Yeast transformations were performed in a 96-well format using the lithium acetate procedure. See Ito et al., J. Bacteriol. 153: 163 (1983). Five µl from individual transformations were grown on selective media lacking leucine (Sc-Leu) or tryptophan (Sc-Trp) for two days and grown at 30° C. Patches of transformants were manually transferred into individual wells on micro-assay plates, to generate 64 barcoded 96-well plates for further use.

Of the 6144 ORFs, 5345 (87%) were successfully cloned into both plasmids (Table 1). Transformants from the Gal4 activation domain array were pooled to form an activation domain library. As yeast strains of opposite mating type were used to generate the two arrays, each binding domain fusion transformant was mated in duplicate to the activation domain library, and diploid cells that expressed interacting pairs were selected. Mating reactions were performed on 96-well filter plates (Millipore MAHV S45) by mixing $10^7$ MATa cells (Gal4 binding domain fusion) with $5\times10^6$ MATα cells (activation domain library) from liquid cultures in complete media (YPAD). After filtration, the 96-well filter plates were incubated overnight at 30° C. on rectangular YPAD solid media plates. Cells were collected from each filter with sterile water and the diploids containing potential interactors were selected on media lacking uracil and simultaneously screened by the addition of X-gal by incubating 4 days at 30° C. Each mating generated $5\times10^5$ to $10^6$ diploids per well, and was performed in duplicate to insure the reproducibility of the results. Up to 12 blue colonies were picked per mating and submitted for PCR and sequencing. A total of 8676 blue colonies were picked from the screen, 6909 (80%) passed PCR, sequencing, vector trimming, and annotation quality control, and 6215 (72%) passed interaction quality control.

To conduct transformation and mating reactions on such a large scale in a timely fashion, 96-well assay plates and a semi-automated Zymark® work station were used throughout the cloning and screening procedures. Sample handling and manipulation during the screens were tracked by computer, and data analysis was carried out using web-based software developed at CuraGen (GeneScape®). The final product of the screening process was a collection of 96-well plates of diploid clones. The activation domain fusion plasmids were sequenced to identify the yeast ORF. The resulting sequences were compared to the yeast sequence database using Blast2. See Altschul et al., J. Mol. Biol. 215: 403 (1990). Using these results, a list of interactors was obtained, as discussed above (see Table 3).

Results from this screen were also compared with a compilation of previously described interactions. Thirty-one protein pairs identified in the present screen were previously reported as two-hybrid interactions, and an additional 18 pairs confirmed interactions previously identified by biochemical assays (co-immunoprecipitation, copurification, affinity column). See MIPS Yeast Genome Database (MYGD) Functional Catalogue, supra.; Mewes et al., supra. Thus, 49 out of the 692 interactions identified in this screen overlap the approximately 700 interactions in S. cerevisiae reported in the literature. See id.

The limited overlap between the results described herein and the literature (7%) can be attributed to specifics of the screen: the exclusive use of full-length proteins as both binding and activation domain fusions and the version of the two-hybrid system used, which includes Gal4 as the binding domain fusion protein, centromeric plasmids, and a stringent reporter gene (URA3). Each of these components can affect the sensitivity of the assay. See Legrain et al., Nucl. Acid. Res. 22: 3241 (1994).

SEQUENCE LISTING (1387 sequences)

SEQ ID NO: 1 - protein, 635 aa, Saccharomyces cerevisiae
  misc_feature (0)...(0): Polypeptide Accession Number YAL016W
MSGARSTTAGAVPSAATTSTTSTTSNSKDSDSNESLYPLALLMDELKHDDIANRVEAMKKLDTIALALGPERTRNELIPFLTEVAQDDEDEVFAVLAEQLGKFVPYIGGPQYATILLPVLEILASAEETLVREKAVDSLNNVAQELSQEQLFSDFVPLIEHLATADWFSSKVSACGLFKSVIVRIKDDSLRKNILALYLQLAQDDTPMVKRAVGKNLPILIDLLTQNLGLSTDEDWDYISNIFQKIINDNQDSVKFLAVDCLISILKFFNAKGDESHTQDLLNSAVKLIGDEAWRVRYMAADRFSDLASQFSSNQAYIDELVQPFLNLCEDNEGDVREAVAKQVSGFAKFLNDPSIILNKILPAVQNLSMDESETVRSALASKITNIVLLLNKDQVINNFLPILLNMLRDEFPDVRLNIIASLKVVNDVIGIELLSDSLLPAITELAKDVNWRVRMAIIEYIPILAEQLGMQFFDQQLSDLCLSWLWDTVYSIREAAVNNLKRLTEIFGSDWCRDEIISRLLKFDLQLLENFVSRFTILSALTTLVPVVSLDVVTEQLLPFISHLADDGVPNIRFNVAKSYAVIVKVLIKDEAKYDALIKNTILPSLQTLCQDEDVDVKYFAKKSLAECQELLKN

SEQ ID NO: 2 - protein, 379 aa, Saccharomyces cerevisiae
  misc_feature (0)...(0): Polypeptide Accession Number YAL032C
MFSNRLPPPKHSQGRVSTALSSDRVEPAILTDQIAKNVKLDDFIPKRQSNFELSVPLPTKAEIQECTARTKSYIQRLVNAKLANSNNRASSRYVTETHQAPANLLLNNSHHIEVVSKQMDPLLPRFVGKKARKVVAPTENDEVVPVLHMDGSNDRGEADPNEWKIPAAVSNWKNPNGYTVALERRVGKALDNENNTINDGFMKLSEALENADKKARQEIRSKMELKRLAMEQEMLAKESKLKELSQRARYHNGTPQTGAIVKPKKQTSTVARLKELAYSQGRDVSEKIILGAAKRSEQPDLQYDSRFFTRGANASAKRHEDQVYDNPLFVQQDIESIYKTNYEKLDEAVNVKSEGASGSHGPIQFTKAESDDKSDNYGA

SEQ ID NO: 3 - protein, 289 aa, Saccharomyces cerevisiae
  misc_feature (0)...(0): Polypeptide Accession Number YAL034W-A
MSAPTMRSTSILTEHLGYPPISLVDDIINAVNEIMYKCTAAMEKYLLSKSKIGEEDYGEEIKSGVAKLESLLENSVDKNFDKLELYVLRNVLRIPEEYLDANVFRLENQKDLVIVDENELKKSEEKLREKVNDVELAFKKNEMLLKRVTKVKRLLFTIRGFKQKLNELLKCKDDVQLQKILESLKPIDDTMTLLTDSLRKLYVDSESTSSTEEVEALLQRLKTNGKQNNKDFRTRYIDIRTNNVLRKLGLLGDKEDEKQSAKPDARTQAGDIVSIDIEEPQLDLLDDVL

SEQ ID NO: 4 - protein, 369 aa, Saccharomyces cerevisiae
  misc_feature (0)...(0): Polypeptide Accession Number YAL036C
MSTTVEKIKAIEDEMARTQKNKATSFHLGQLKAKLAKLRRELLTSASSGSGGGAGIGFDVARTGVASVGFVGFPSVGKSTLLSKLTGTESEAAEYEFTTLVTVPGVIRYKGAKIQMLDLPGIIDGAKDGRGRGKQVIAVARTCNLLFIILDVNKPLHHKQIIEKELEGVGIRLNKTPPDILIKKKEKGGISITNTVPLTHLGNDEIRAVMSEYRINSAEIAFRCDATVDDLIDVLEASSRRYMPAIYVLNKIDSLSIEELELLYRIPNAVPISSGQDWNLDELLQVMWDRLNLVRIYTKPKGQIPDFTDPVVLRSDRCSVKDFCNQIHKSLVDDFRNALVYGSSVKHQPQYVGLSHILEDEDVVTILKK

SEQ ID NO: 5 - protein, 580 aa, Saccharomyces cerevisiae
  misc_feature (0)...(0): Polypeptide Accession Number YAL040C
MAILKDTIIRYANARYATASGTSTATAASVSAASCPNLPLLLQKRRAIASAKSKNPNLVKRELQAHHSAISEYNNDQLDHYFRLSHTERPLYNLTNFNSQPQVNPKMRFLIFDFIMYCHTRLNLSTSTLFLTFTILDKYSSRFIIKSYNYQLLSLTALWISSKFWDSKNRMATLKVLQNLCCNQYSIKQFTTMEMHLFKSLDWSICQSATFDSYIDIFLFQSTSPLSPGVVLSAPLEAFIQQKLALLNNAAGTAINKSSSSQGPSLNINEIKLGAIMLCELASFNLELSFKYDRSLIALGAINLIKLSLNYYNSNLWENINLALEENCQDLDIKLSEISNTLLDIAMDQNSFPSSFKSKYLNSNKTSLAKSLLDALQNYCIQLKLEEFYRSQELETMYNTIFAQSFDSDSLTCVYSNATTPKSATVSSAATDYFSDHTHLRRLTKDSISPPFAFTPTSSSSSPSPFNSPYKTSSSMTTPDSASHHSHSGSFSSTQNSFKRSLSIPQNSSIFWPSPLTPTTPSLMSNRKLLQNLSVRSKRLFPVRPMATAHPCSAPTQLKKRSTSSVDCDFNDSSNLKKTR

SEQ ID NO: 6 - protein, 246 aa, Saccharomyces cerevisiae
  misc_feature (0)...(0): Polypeptide Accession Number YAL049C
MASNQPGKCCFEGVCHDGTPKGRREEIFGLDTYAAGSTSPKEKVIVILTDVYGNKFNNVLLTADKFASAGYMVFVPDILFGDAISSDKPIDRDAWFQRHSPEVTKKIVDGFMKLLKLEYDPKFIGVVGYCFGAKFAVQHISGDGGLANAAAIAHPSFVSIEEIEAIDSKKPILISAAEEDHIFPANLRHLTEEKLKDNHATYQLDLFSGVAHGFAARGDISIPAVKYAKEKVLLDQIYWFNHFSNV

SEQ ID NO: 7 - protein, 426 aa, Saccharomyces cerevisiae
  misc_feature (0)...(0): Polypeptide Accession Number YAR003W
MNILLQDPFAVLKEHPEKLTHTIENPLRTECLQFSPCGDYLALGCANGALVIYDMDTFRPICVPGNMLGAHVRPITSIAWSPDGRLLLTSSRDWSIKLWDLSKPSKPLKEIRFDSPIWGCQWLDAKRRLCVATIFEESDAYVIDFSNDPVASLLSKSDEKQLSSTPDHGYVLVCTVHTKHPNIIIVGTSKGWLDFYKFHSLYQTECIHSLKITSSNIKHLIVSQNGERLAINCSDRTIRQYEISIDDENSAVELTLEHKYQDVINKLQWNCILFSNNTAEYLVASTHGSSAHELYIWETTSGTLVRVLEGAEEELIDINWDFYSMSIVSNGFESGNVYVWSVVIPPKWSALAPDFEEVEENVDYLEKEDEFDEVDEAEQQQGLEQEEEIAIDLRTREQYDVRGNNLLVERFTIPTDYTRIIKMQSS

SEQ ID NO: 8 - protein, 702 aa, Saccharomyces cerevisiae
  misc_feature (0)...(0): Polypeptide Accession Number YAR014C
MSNKEEHVDETSASGVKEVSSIAARHDNGYAPSLITSTSGMDSFQSHALLNDPTLIEDYSDIINNRPTSGSKLTLGNEDSESMGGSVVVTPTSNKSSPFNSKLNILSNAAEKGHDVLRNRDDDKELEEENVEKHMHSNSKRDQRHYKENSSELPDSYDYSDSEFEDNLERRLQEIETDSVDSADKDEVHFSVNNTMNPDVDDFSDGLKYAISEDEDEEENYSDDDDFDRKFQDSGFQGEKDDLEEENDDYQPLSPPRELDPDKLYALYAFNGHDSSHCQLGQDEPCILLNDQDAYWWLVKRITDGKIGFAPAEILETFPERLARLNCWKNENMSSQSVASSDSKDDSISSGNKNQSDAESIIPTPALNGYGKGNKSVSFNDVVGYADRFIDDAIEDTSLDSNDDGGEGNGQSYDDDVDNDKETKVTHRDEYTEAKLNFAKFQDDDTSDVVSDVSFSTSLNTPLNVKKVRRQDNKNESEPKTSSSKDREDDYNANRYVGQEKSEPVDSDYDTDLKKVFEAPRMPFANGMAKSDSQNSLSTIGEFSPSSSEWTNESPSTPIVEESSSIPSSRAIRTFTYIMQNRKLRDNKRGKHRGQIQASLGSSGGMPNQTDAEQPKEELEKHHSTPEEEKQSTLSLHSSSEEDFYMDEQRAVSSASINSSLSGSRALSNTNMSDPASKPNSLVQHLYAPVFDRMDVLMKPIG

SEQ ID NO: 9 - protein, 298 aa, Saccharomyces cerevisiae
  misc_feature (0)...(0): Polypeptide Accession Number YAR031W
MSPQYHFYFVSFRNLVLNEKCLRSKKQVMKSFNWYKTDRYFDPHNILQHHSRAIEKTRYKLGMQTSSESTDAKSDFLDEPSAYLIEKNVALPKDIFGSYLSYWIYEVTRHKAAVILLVLIVTSILLLVFFYNTEFCVAFEILLFSFCFPGTCMVVIAFSEPIGDREFKVKLLMEIITRKPAVKGKEWRTITYKMNQYLFDHGLWDTPYYFYRDEDCHRYFLSLIKGRTFKKQKESSASNVKDAQSNDETAGTPNEAAESSSFSAGPNFIKLLTKAAEIEQQFQKEYWRQEYPGVDEFF

SEQ ID NO: 10 - protein, 234 aa, Saccharomyces cerevisiae
  misc_feature (0)...(0): Polypeptide Accession Number YAR033W
MQTPPESTDVKLDTLNEPSAHLIEKNVALPKDIFRSYLSYWIYEIARYTPVMILSLVIGVLVLLIIFFNDNEACVFNSAIFAFTSLVGLLIILSDGNPKLVSRRNFRTELLVDVITRKPAVEGKEWRIITYNMNQYLFNHGQWHTPYYFYSDEDCYRYFLRLVEGVTPKKQTATSIGNSPVTAKPEDAIESASPSSRLNYQNFLLKAAEIERQAQENYWRRRHPNIDALLKKTE

SEQ ID NO: 11 - protein, 203 aa, Saccharomyces cerevisiae
  misc_feature (0)...(0): Polypeptide Accession Number YAR066W
MFNRFNKFQAAVALALLSRGALGDSYTNSTSSADLSSITSVSSASASATASDSLSSSDGTVYLPSTTISGDLTVTGKVIATEAVEVAAGGKLTLLDGEKYVFSSDLKVHGDLVVEKSEASYEGTAFDVSGETFEVSGNFSAEETGAVSASIYSFTPSSFKSSGDISLSLSKAKKGEVTFSPYSNAGTFSLSNAILNGGSVSGL

SEQ ID NO: 12 - protein, 1244 aa, Saccharomyces cerevisiae [sequence omitted]

SEQ ID NO: 13 - protein, 280 aa, Saccharomyces cerevisiae
  misc_feature (0)...(0): Polypeptide Accession Number YBL010C
MSDRDQIEPVTNALDAESDSSDDFGNFSDASVENDLYNQNSTLTTSSESVVDNCLNKILPKGEFDLEEETIKNDCFKLSKLIEDERPHVIYEQLVQLDPVLQPFIWNKSHIRRNLLHILRLSDNNGSEGVGTKREEEPLNDELFKRICDAVEKNEQTATGLFLRDNFKIDYTPPMTLKSLQKEEEREQEQHIPQLLMADFTSMDEESLRQYHDTLCQSIDFLVSKSRSLKKQQRDLLKDKTTFENVVTNLTGHTQRLQRDEIALYNKKRNKKKRFSWVGY

SEQ ID NO: 14 - protein, 894 aa, Saccharomyces cerevisiae
  misc_feature (0)...(0): Polypeptide Accession Number YBL014C
MSEGQIPSSDVLGSQLGVGVQGASLYCPQENYTTKKQENPQWLRPVDDTLAEDALDLHIVVKSLLCDTAIRYISDDKVLQESDADDDLITSDIDEDTDNQGDTSIVVNPVIPVVPKDVHFFKKVDVGNDSMFGVNCDTPVSFQDYIPSDLLRNLDDTLQESTNSSRPMQDAFFWDPTVANRLDSQYIQTASDLRNYRDGTEIIAYASGKTGSVLNIAVLTRQNTLHLNRHNNVTSIELHSPIKSIKIPGASESIGRRSNLVGIITENSFQIFRIESVHSRSCDVMVSSSEPLYFVEIDDLQVVDFAFNPWDLQQFAIIDIKGNWSIGRIPKNFNNNNKRKLQLIDNLHGTIFDPEELSSWKRIEWFSHFQKILVFDRSKMIEIDFMNNWQTEVVQAKAWSNIRDYKRIDDKNGILLTSREIIIVGASESNDPVRRISWKHDLDPDDTTLRITVQKVKKPDHILLVAFVYSMRHKRIYMHVFSHRKANLFQSLGCSTVLEIPGGTPTGIETILTLDHIDDESRREEDADENFELVVDFLVKLRNSSEVYYYALSNTQNSEPNKQETPIIVDHPEWASLFNNADEREKESIGALVSQIKLKERERISRVQNLIEHENSHDEDKYLQDLGYRLSIATNELLESWQKTKDESILSGSLSHSKLKNLLENSDSFASIPEFSSLLDQFFQYYQDQDVTFIGFEKLLHLFLHEDVPGLDIFYNKLLQCWVLVSPQAELLTKEIVKDIIWSLARLEKPSLFEPIQNEISRSLSGPYQDIISSWDMDDINEEDESNEFNFDSQFSAPFNGRPPFNLNSQSQIPTIKSSQSSGLARRKRILKTQSQKATPLSQSTQNLSVLPDSMTPAFTLMQPPSSQISFVNDSQPRNSQKAKKKKKRIRGFG

SEQ ID NO: 15 - protein, 144 aa, Saccharomyces cerevisiae [sequence omitted]

SEQ ID NO: 16 - protein, 145 aa, Saccharomyces cerevisiae
  misc_feature (0)...(0): Polypeptide Accession Number YBL025W
MDRNVYEACSNIIKEFGTHVVSADEVLAEKIDNAVPIPFKTREEIDADVEKDRNEGVFEGNIIPDIDLRVVHYYATQLCLNKYPHLINAFDETSLITLGLLIEKWVKDYLTSIQTEQGRQSKVIGKGPCEFISKHIDYRHAPGNI

SEQ ID NO: 17 - protein, 639 aa, Saccharomyces cerevisiae
  misc_feature (0)...(0): Polypeptide Accession Number YBL042C
MPVSDSGFDNSSKTMKDDTIPTEDYEEITKESEMGDATKITSKIDANVIEKKDTDSENNITIAQDDEKVSWLQRVVEFFEVKNDSTDLADHKPENPIRTFKDLQESLRSTYLYNTDLRPVEAKRRTWTWKQYIFFWISGSFNVNTWQISATGLQLGLNWWQTWICIWVGYTFVAFFLILGSKVGNNYHISFPISSRVSFGIYFSIWIVINRVVMACVWNSTLAYIGSQCVQLMLKAIFGTNLNTRIKDTIKNPNLTNFEFMCFMVFWVACLPFLWFPPDKLRHIFALKSAITPFAAFGFLIWTLCKAKGHLALGSLNDNGGAISKTVLAWSVIRAIMSALDNFSTLILNAPDFTRFGKTYKSSVYSQLIALPVCYAIISLIGILSVSAAYTLYGVNYWSPLDILNRYLDNYTSGNRAGVFLISFIFAFDQLGANLSGNSIPAGTDLTALLPKFINIRRGSYICALISLAICPWDLLSSSSKFTTALAAYAVFLSAIAGVISADYFIVRKGYVNIFHCYTDKPGSYYMYNKYGTNWRAVVAYIFGIAPNFAGFLGSVGVSVPIGAMKVYYLNYFVGYLLAALSYCILVYFYPIKGIPGDAKITDRKWLEEWVEVEEFGTEREAFEEYGGVSTGYEKIRYI

SEQ ID NO: 18 - protein, 257 aa, Saccharomyces cerevisiae
  misc_feature (0)...(0): Polypeptide Accession Number YBL043W
MNSTTPSIQDQYILASKVRSKLAKCVSVTTKNKDYNLRVLVGHANLLDKITENVETHNAATNALAGDPFSKGPENLSIEHIELSNANASKNDVGKEENAEKTIESEDYCDFYSSDEDPDADTLSSTDSEDDDDYEDYDFEYDYSGGDYNKKIDMYFSFHTAPNYQYLTHTNSHSEQTDELAESTPRYNALPATASTTEEEQDTETLDAVSLHSSAPIFRVLSRRVNGQEDDSENESSSDVDDGSVPLTRFHSCPITA

SEQ ID NO: 19 - protein, 668 aa, Saccharomyces cerevisiae
  misc_feature (0)...(0): Polypeptide Accession Number YBL051C
METSSFENAPPAAINDAQDNNINTETNDQETNQQSIETRDAIDKENGVQTETGENSAKNAEQNVSSTNLNNAPTNGALDDDVIPNAIVIKNIPFAIKKEQLLDIIEEMDLPLPYAFNYHFDNGIFRGLAFANFTTPEETTQVITSLNGKEISGRKLKVEYKKMLPQAERERIEREKREKRGQLEEQHRSSSNLSLDSLSKMSGSGNNNTSNNQLFSTLMNGINANSMMNSPMNNTINNNSSNNNNSGNIILNQPSLSAQHTSSSLYQTNVNNQAQMSTERFYAPLPSTSTLPLPPQQLDFNDPDTLEIYSQLLLFKDREKYYYELAYPMGISASHKRIINVLCSYLGLVEVYDPRFIIIRRKILDHANLQSHLQQQGQMTSAHPLQPNSTGGSMNRSQSYTSLLQAHAAAAANSISNQAVNNSSNSNTINSNNGNGNNVIINNNSASSTPKISSQGQFSMQPTLTSPKMNIHHSSQYNSADQPQQPQPQTQQNVQSAAQQQQSFLRQQATLTPSSRIPSGYSANHYQINSVNPLLRNSQISPPNSQIPINSQTLSQAQPPAQSQTQQRVPVAYQNASLSSQQLYNLNGPSSANSQSQLLPQHTNGSVHSNFSYQSYHDESMLSAHNLNSADLIYKSLSHSGLDDGLEQGLNRSLSGLDLQNQNKKNLW

SEQ ID NO: 20 - protein, 117 aa, Saccharomyces cerevisiae
  misc_feature (0)...(0): Polypeptide Accession Number YBL078C
MKSTFKSEYPFEKRKAESERIADRFKNRIPVICEKAEKSDIPEIDKRKYLVPADLTVGQFVYVIRKRIMLPPEKAIFIFVNDTLPPTAALMSAIYQEHKDKDGFLYVTYSGENTFGR

SEQ ID NO: 21 - protein, 438 aa, Saccharomyces cerevisiae
  misc_feature (0)...(0): Polypeptide Accession Number YBL101W-A
MESQQLHQNPHSLHGSAYASVTSKEVSSNQDPLAVSASNLPEFDRDSTKVNSQQETTPGTSAVPENHHHVSPQPASVPPPQNGQYQQHGMMTPNKAMASNWAHYQQPSMMTCSHYQTSPAYYQPDPHYPLPQYIPPLSTSSPDPIDSQDQHSEVPQAKTKVRNNVLPPHTLTSEENFYTWVKFYIRFLKNSNLGDIIPNDQGEIKRQMTYEEHAYIYNTFQAFAPFHLLPTWVKQILEINYADILTVLCKSVSKMQTNNQELKDWIALANLEYDGSTSADTFEITVSTIIQRLKENNINVSDRLACQLILKGLSGDFKYLRNQYRTKTNMKLSQLFAEIQLIYDENKIMNLNKPSQYKQHSEYKNVSRTSPNTTNTKVTTRNYHRTNSSKPRAAKAHNIATSSKFSRVNNDHINESTVSSQYLSDDNELSLRPATERI

SEQ ID NO: 22 - protein, 215 aa, Saccharomyces cerevisiae
  misc_feature (0)...(0): Polypeptide Accession Number YBL102W
MSEEPPSDQVNSLRDSLNRWNQTRQQNSQGFNESAKTLFSSWADSLNTRAQDIYQTLPVSRQDLVQDQEPSWFQLSRTERMVLFVCFLLGATACFTLCTFLFPVLAAKPRKFGLLWTMGSLLFVLAFGVLMGPLAYLKHLTARERLPFSMFFFATCFMTIYFAAFSKNTVLTITCALLELVAVIYYAISYFPFGATGLRMLSSAGVNSARGVLRI

SEQ ID NO: 23 - protein, 1151 aa, Saccharomyces cerevisiae
  misc_feature (0)...(0): Polypeptide Accession Number YBL105C
MSFSQLEQNIKKKIAVEENIIRGASALKKKTSNVMVIQKCNTNIREARQNLEYLEDSLKKLRLKTAQQSQGENGSEDNERFNSKEYGFLSTKSPNEHIFSRLDLVKYDCPSLAQRIQYMLQQLEFKLQVEKQYQEANTKLTKLYQIDGDQRSSSAAEGGAMESKYRIQMLNKALKKYQAINVDFDQFKHQPNDIMDNQQPKFRRKQLTGVLTIGITAARDVDHIQSPMFARKPESYVTIKIDDTIKARTKPSRNDRWSEDFQIPVEKGNEIEITVYDKVNDSLIPVAIMWLLLSDIAEEIRKKKAGQTNEQQGWVNASNINGGSSLASEEGSTLTSTYSNSAIQSTSAKNVQGENTSTSQISTNSWFVLEPSGQILLTLGFHKSSQIERKQLMGGLHRHGAIINRKEEIFEQHGHHFVQKSFYNIMCCAYCGDFLRYTGFQCQDCKFLCHKKCYTNVVTKCIAKTSTDTDPDEAKLNHRIPHRFLPTSNRGTKWCCHCGYILPWGRHKVRKCSECGIMCHAQCAHLVPDFCGMSMEMANKILKTIQDTKRNQEKKKRTVPSAQLGSSIGTANGSDLSPSKLAERANAPLPPQPRKHDKTPSPQKVGRDSPTKQHDPIIDKKISLQTHGREKLNKFIDENEAYLNFTEGAQQTAEFSSPEKTLDPTSNRRSLGLTDLSIEHSQTWESKDDLMRDELELWKAQREEMELEIKQDSGEIQEDLEVDHIDLETKQKLDWENKNDFREADLTIDSTHTNPFRDMNSETFQIEQDHASKEVLQETVSLAPTSTHPSRTTDQQSPQKSQTSTSAKHKKRAAKRRKVSLDNFVLLKVLGKGNFGKVILSKSKNTDRLCAIKVLKKDNIIQNHDIESARAEKKVFLLATKTKHPFLTNLYCSFQTENRIYFAMEFIGGGDLMWHVQNQRLSVRRAKFYAAEVLLALKYFHDNGVIYRDLKLENILLTPEGHIKIADYGLCKDEMWYGNRTSTFCGTPEFMAPEILKEQEYTKAVDWWAFGVLLYQMLLCQSPFSGDDEDEVFNAILTDEPLYPIDMAGEIVQIFQGLLTKDPEKRLGAGPRDADEVMEEPFFRNINFDDILNLRVKPPYIPEIKSPEDTSYFEQEFTSAPPTLTPLPSVLTTSQQEEFRGFSFMPDDLDL

SEQ ID NO: 24 - protein, 435 aa, Saccharomyces cerevisiae
  misc_feature (0)...(0): Polypeptide Accession Number YBR006W
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNT

SEQ ID NO: 25 - protein, 298 aa, Saccharomyces cerevisiae
  misc_feature (0)...(0): Polypeptide Accession Number YBR040W
MVAISMIWFFTKRMPRIFALAFNLISIFLLIFLLIGCYNPSNQSTFLVKYKFDDNSPFYTIIEKSYEKSNTTLGLEEVIIRSGYMGVCIDNIPSQYSSYNNMTTFSNSICYARKNLSSVPLYRDLEIQLSNIASSSSKTQSSVVLNILKLAQLTSVNVIHPYVLMATVILTILMFLFILYVTVPKLPFKLAVNKFLLLLSSTIVLTWGIGAMWTHVGINASYRLVPSSSMNIITVKKGKKAAVMAWFSFAFLLLDSVVLWLIFLRDRKSLKDEIDNVPCAQNRYNNYSSDSSTLHSKV

SEQ ID NO: 26 - protein, 210 aa, Saccharomyces cerevisiae
  misc_feature (0)...(0): Polypeptide Accession Number YBR052C
MPKVAILIYSVDDIIATLAENEKKGIEIAGGEAEIFQVPDVSYKTEYATEEGKEAAKVAKTNADFSYKILTRETLVEYDYYLFGIPTKFGNFPAEWKSFWDSNTGGLWAKGSLHGKIAGLFVSGAISGKGDTEMCIMNAMSTLVHHGVIYVPLGYKNAYKELTDVEDVNGSCAWGAGCVSGIDGGRPPSLSELRVHQLQGKAFYDRIKDL

SEQ ID NO: 27 - protein, 899 aa, Saccharomyces cerevisiae
  misc_feature (0)...(0): Polypeptide Accession Number YBR055C
MERPSFLDQEPPAGYVPGIGRGATGFSTKEKQVVSNDDKGRRIPKRYRENLNNHLQSQPKDDEDDEAANVFKTLELKLAQKKKKRANEKDDDNSVDSSNVKRQFADLKESLAAVTESEWMDIPDATDFTRRNKRNRIQEQLNRKTYAAPDSLIPGNVDLNKLTEEREKLLQSQIDENLAQLTKNASNPIQVNKPNAATDALSYLKDLENDRVNSLSDATLEDLQKMRTILKSYRKADPTNPQGWIASARLEEKARKFSVAKKIIENGCQECPRSSDIWLENIRLHESDVHYCKTLVATAINFNPTSPLLWFKAIDLESTTVNKYRVVRKALQEIPRDEGLWKLAVSFEADKAQVIKMLEKATQFIPQSMDLLTAYTNLQSYHNAKMTLNSFRKILPQEPEIWIISTLLEERNNPDIPVDKLVSLLKEGLLELSKNGYKATLSAWLKRAEALNDAPNSNLTCQAIVYAILEWLRESGEYESELNNVDQILEKMPHSKVQIAVLKKLIQWDPCDTVLWSRLKMATESYHKIEELLAFFQELLFQTKNSDDIRANMREKSPGLLMMYVSEYWKAQKGDTRQTLVLIDQIIDFAPHNLDLRFFKIKLLGRSLQLDELRDFFQQTFSSLEDFKISGTERLYYKYVNFLRYQDLNEEAIKFLNERCLKSFPICHKFFLQLGQIYHSMGNIEMSRETYLSGTRLVPNCPLLWVSLSKIDEIDLKNPVRARSILDRGLLKNPDDVLFYIAKIQMEIRLGNLDQAELLVTQALQKFPSNALLWVEQIKLFKHGNKSSLKKTIFQDALRRTQNDHRVLLEIGVSFYAEAQYETSLKWLERALKKCSRYGDTWVWLFRTYARLGKDTVDLYNMFDQCEPTYGPEWIAASKNVKMQYCTPREILLRLMNDK

SEQ ID NO: 28 - protein, 366 aa, Saccharomyces cerevisiae
  misc_feature (0)...(0): Polypeptide Accession Number YBR057C
MNYMAYDYDPQHSLETSFNNLAFHPHQQSQQQALYESGERNDARPGLMNTLGQASKMNNSMLPQGSSASPLTGQHSLNSTTNFNMPPSMNTYNYQNVPQASMRNTLNHNNIMNGATANDYWLDPMNNMTNNKDTNGNPNDSMSSMSNMTAKTSINSTAFKNSFVPFNHVTALSMNNVNSNEMNSNKDDRMEALEVELQIKESQIESLENEIQRLKKIFNEGLNYKQNEHKYEKENCHIPQTFELPASLEVIFRKLSSSLHAKEKELAETKENLESILTALALNPTNSVTKYGRYDAESIAHKMVVRLENLTNENKEMAKMLAYGRSKETQIELQLAKKENLELREKIASLEAHLASKESSKEDVAN

SEQ ID NO: 29 - protein, 1108 aa, Saccharomyces cerevisiae
  misc_feature (0)...(0): Polypeptide Accession Number YBR059C
MSITNGTSRSVSAMGHPAVERYTPGHIVCVGTHKVEVVNYLAEGGFAQIYVVKFLEYLNEFDNTASVPLKIGDVACLKRVLVQDENGLNEMRNEVEVMKKLKGAPNIVQYFDSNASRRRDGVQGFEVLLLMELCPNKSLLDYMNQRLSTKLTEAEIVKIMYDVALSISQMHYLPVSLIHRDIKIENVLVDAKNNFKLADFGSTSTCFPIVTTHQDIALLTQNIYVHTTPQYRSPEMIDLYRCLPINEKSDIWALGVFLYKLLFFTTPFEMTGQFAILHSKYEFPVNKYSSKLINLIIIMLAENPNLRPNIYQVLYHLCEILNVEVPIEDKYAEGAYNFSKYTQFQNKLQNVQLQMYQLQQKKIMQNNKLSDSEENLLNDMFLSSFEISSKLPMNASDGHAAVSRIPSQNVGQELEEEKESQSDQRKSTLSEDKSSRTTSNANSSGTANNPQEINTIQSPGIEDKSIFENKTPGELYYPSVSELDTYLDKELVKQSSDPTISEQSPRLNTQSLPQRQKSTSSYSSGGRSMKSTSYGAATIGSDEALANEKTAGINKMKQHKSNNPFPKMNVAYHSTNELSNDASNFFLEEQQQGQRYQQAQNQTGTQGNTFPDESQYQSRVEQQQQQQDQPKGPANYSQRNFYTGRDRSNKPMQLGGTIAGDSGNRRVNFQNISQNYATNSQSGYLPSQNSPAIPMVRPVISMNQQQAQQIQAQQLQAQQMQAKQQMQAKQQMQVQQQLQVQQQMQIQNANNNGTYVSDRTNHTTEDMRNAQGGEPPILAGNSANEPMHSSSKNEALLIELSPLKEDAGKQSFQDTNEPQTGGIEDAGGSGTIKGSNNNRNGVLNLSLNEMDLSRDDTGAAVSSFSSSSSSASIQQAKLSGRKGSSKRNNYSTDELGDSMVSSESIDIDLDDARRGKTAERRPLHNERGHKDQARSSDASKSNQFKSKDFSSVSTRQPRQSLDLNFQEVNLSSPTLTQEHRNKNDSPAPNSHHSYRVSPHASTAITENKRHSTGHELSTRSNGKHETHRTGSKQRHDLERYRHSKDKDSNSSITISTSTPSEMRKSFARARQSLDLERVRREAMASSASSSGGSNGKRRSFFSVFRSEK

SEQ ID NO: 30 - protein, 162 aa, Saccharomyces cerevisiae
  misc_feature (0)...(0): Polypeptide Accession Number YBR077C
MVMLHSKNVKGFLENTLKPYDLHSVDFKTSSLQSSMIITATNGGILSYATSNNDVPKNSINEINSVNNLKMMSLLIKDKWSEDENDTEEQHSNSCYPVEIDSFKTKIYTYEMEDLHTCVAQIPNSDLLLLFIAEGSFPYGLLVIKIERAMRELTDLFGYKLG

SEQ ID NO: 31 - protein, 753 aa, Saccharomyces cerevisiae
  misc_feature (0)...(0): Polypeptide Accession Number YBR094W
MRVLITNDDGPLSDQFSPYIRPFIQHIKRNYPEWKITVCVPHVQKSWVGKAHLAGKNLTAQFIYSKVDAEDNTFWGPFIQPQIRSENSKLPYVLNAEIPKDTIEWILIDGTPASCANIGLHLLSNEPFDLVLSGPNVGRNTSAAYITSSGTVGGAMESVITGNTKAIAISWAYFNGLKNVSPLLMEKASKRSLDVIKHLVKNWDPKTDLYSINIPLVESLSDDTKVYYAPIWENRWIPIFNGPHINLENSFAEIEDGNESSSISFNWAPKFGAHKDSIHYMDEYKDRTVLTDAEVIESEMISVTPMKATFKGVNHLLGELKLTEEENNLSKTNNLIVVSIDPMEYIYKPLTHALKKYLPQVEIVSNLPEFDNGGCEKEMKVFHYGDYEQLDMDKLMELPNNYFTNSYIYRKALIRKHFLSHTIQTYTAKNPESILKKAYLESFTIDLDYREFLDDALDENWELRQELENESQDKWWIVKPSMSDKGQGIRVFKTIEDLQAIFDSFDDEDSEAEESGNDDDADDVNGEFMDNNKVNISQLRHFIIQEYLTNPLLLASMDNRKFHIRCYVVCRGDLQVFVYDRMLALFAAKPFVPLDPYAYSVTDLKDLECHLTNTCLQSKKKDKDSSVLEFDSIEEIPNERKSNIKEQIHSITNDVFLAAVNVNRLNFQPLPNAFETYGVDFLIDSNYEVKLLEINAFPDFKQTGKDLKNLIDELFDDTVKYCVTPIFNENRNKTDDETDPNFVKVIDYTSNGW

SEQ ID NO: 32 - protein, 535 aa, Saccharomyces cerevisiae
  misc_feature (0)...(0): Polypeptide Accession Number YBR103W
MSITSEELNYLIWRYCQEMGHEVSALALQDETRVLEFDEKYKEHIPLGTLVNLVQRGILYTESELMVDSKGDISALNEHHLSEDFNLVQALQIDKEKFPEISSEGRFTLETNSESNKAGEDGASTVERETQEDDTNSIDSSDDLDGFVKILKEIVKLDNIVSSTWNPLDESILAYGEKNSVARLARIVETDQEGKKYWKLTIIAELRHPFALSASSGKTTNQVTCLAWSHDGNSIVTGVENGELRLWNKTGALLNVLNFHRAPIVSVKWNKDGTHIISMDVENVTILWNVISGTVMQHFELKETGGSSINAENHSGDGSLGVDVEWVDDDKFVIPGPKGAIFVYQITEKTPTGKLIGHHGPISVLEFNDTNKLLLSASDDGTLRIWHGGNGNSQNCFYGHSQSIVSASWVGDDKVISCSMDGSVRLWSLKQNTLLALSIVDGVPIFAGRISQDGQKYAVAFMDGQVNVYDLKKLNSKSRSLYGNRDGILNPLPIPLYASYQSSQDNDYIFDLSWNCAGNKISVAYSLQEGSVVAI

SEQ ID NO: 33 - protein, 848 aa, Saccharomyces cerevisiae
  misc_feature (0)...(0): Polypeptide Accession Number YBR108W
MGFWENNKDSITSGLKSAGKYGYQGTKYVAKTGYKASKKHYNNSKARRERKSGKKNSSDEEYDSEDEMEYERKPTDIRSLKDPKSFPPPPLKPGQKTYTGQQQQQMPNGQASYAFQGAYQGQPGAGSTEQSQYAQPQYNQYPQQQLQQGVMPQQQQLQQGVVPQQPPIYGEQVPPYGSNSNATSYQSLPQQNQPQNAIPSQVSLNSASQQSTGFVSQNLQYGTQSSNPAPSPSFQNGLQCHQQPQYVSHGSTNLGQSQFPSGQQQQPTTQFGQQVLPSPAQPQQQQQGQPLPPPRGQVILPAPGEPLSNGFGQQQQQQQQQQQPLNQNNALLPQMNVEGVSGMAAVQPVYGQAMSSTTNMQDSNPSYGASPMQGQPPVGGQPPVPVRMQPQPPQPMQQGNIYPIEPSLDSTGSTPHFEVTPFDPDAPAPKPKIDIPTVDVSSLPPPPTHRDRGAVVHQEPAPSGKIQPNTTSSAASLPAKHSRTTTADNERNSGNKENDESTSKSSILGHYDVDANIMPPPKPFRHGLDSVPSEHTTKNAPERAVPILPPRNNVEPPPPPSRGNFERTESVLSTNAANVQEDPISNFLPPPKPFRHTETKQNQNSKASPVEMKGEVLPGHPSEEDRNVEPSLVPQSKPQSQSQFRRAHMETQPIQNFQPPPKPFRRSQSSNSSDSSYTIDGPEANHGRGRGRIAKHHDGDEYNPKSENSTENGRLGDAPNSFIRKRAPTPPAPSRSEKLHEGTITSEVDSSKDANKYEKSIPPVTSSIQAQQSTKKAPPPVVKPKPRNFSLKANEYPKELTREATGQDEVLNSITNELSHIKLRKTNVNLEKLGGSKKVKTLALFPQI

SEQ ID NO: 34 - protein, 393 aa, Saccharomyces cerevisiae
  misc_feature (0)...(0): Polypeptide Accession Number YBR125C
MGQLLSHPLTEKTIEYNEYKNNQASTGIVPRFYNCVGSMQGYRLTQEDAHLIRNENSVVYVRFFNPFIDKYETLSLNVFAVFDGHGGDDCSKFLSGGRHHRDGNGSSNGNGEPNAGLIKWIAYSFENHHYTSTTNNDSSKFKRSFNTLEGLVSQIFKDAFILQDEELYRHFANSSCGSTAVVACIINEESLYVANCGDSRCILSSKSNGIKTMSFDHKPQHIGELIRINDNGGTVSLGRVGGVLALSRAFSDFQFKRGVTYPHRRTKLTNITQNLTYGTPPQEAQVTVEPDVLMHKIDYSKDEFLVLACDGIWDIYNNKQLIHFIKYHLVSGTKLDTIITKLLDHGIAQANSNTGVGFDNMTAIIVVLNRKGETLQDWFNKMKTRLERERGLV

SEQ ID NO: 35 - protein, 827 aa, Saccharomyces cerevisiae
  misc_feature (0)...(0): Polypeptide Accession Number YBR133C
MHSNVFVGVKPGFNHKQHSKKSRFLENVSSHSPELPSNYDYVLLPITTPRYKEIVGQVFKDFQRQSIQNWKPLQIPEPQLQDICIPPFNVKKLDNDDTPSYIGLLSSWLELESRDPNVRDLGLKVLLNECKYARFVGINKLILAPPRDLSNLQLYGQMIYRLLQNRIVFAAPALTISISLPLYEDSDPLATWELWNTVRKQCEYHPSLTISLALPRTRTPSYVLNRWLAEPVSCLLVSSSIFASNQYDYPVLHKFNQNLILKFQKVNGDSQILGNELCVILHGMEKYANNVKGGESAYLEYINYLLKKGDKVLNSNSNHQFLLQEDSRIMPPLKPHSDNLLNSTYLTFEKDLVKYDLYESAILEALQDLAPRASAKRPLVILVAGAGRGPLVDRTFKIISMLFMDSKVSIIAIEKNPQAYLYLQKRNFDCWDNRVKLIKEDMTKWQINEPSEKRIQIDLCISELLGSFGCNELSPECLWSIEKYHSHNDTIFIPRSYSSYIAPISSPLFYQKLSQTNRSLEAPWIVHRVPYCILSSRVNEVWRFEHPMAQKDTVQDEDDFTVEFSQSSLNEFKIKHRGEIHGFIGFFSANLYNNIFLSTLPNDSTVRLKFSEETLMNTRREENLIKKCDHTPNMTSWSPIIFPLKQPISFIDDSELSVLMSRIHSDTEQKVWYEWSLESFIYLMLSNYTSAVTAASMTIPRSIVTDDTKTLAHNRHYSATTNQKLDNQIDLDQDIENEEEQGFLSNLETGWQSVQDIHGLSETAKPDHLDSINKPMFDLKSTKALEPSNELPRHEDLEEDVPEVHVRVKTSVSTLHNVCGRAFSLPL

SEQ ID NO: 36 - protein, 133 aa, Saccharomyces cerevisiae
  misc_feature (0)...(0): Polypeptide Accession Number YBR134W
MIKAWFDTNKYVAMHMQTEPFVYIKIICIKEEERPHNSTHTHTHTLSHTQFEIAPIGLGNRITSHSKYTIFSITHTHCIKPFVSKKYKNTAQRAVSGSICDCLFFFWFSSVQNEGSKNFQIKQYSSPEICFRV

SEQ ID NO: 37 - protein, 150 aa, Saccharomyces cerevisiae
  misc_feature (0)...(0): Polypeptide Accession Number YBR135W
MYHHYHAFQGRKLTDQERARVLEFQDSIHYSPRYSDDNYEYRHVMLPKAMLKVIPSDYFNSEVGTLRILTEDEWRGLGITQSLGWEHYECHAPEPHILLFKRPLNYEAELRAATAAAQQQQQQQQQQQQQQQQHQTQSISNDMQVPPQIS

SEQ ID NO: 38 - protein, 337 aa, Saccharomyces cerevisiae
  misc_feature (0)...(0): Polypeptide Accession Number YBR141C
MHSRKSKSITGKRKQVGSNVTRVIKPQKTRRIIRRFHHLINKRQSICKFLCLKENLDDSNEEKNDKIIRLSIKGNVRLGKYYEDGKSQSFNDAMESQLLRLHSLIKNESKSKDTSDLAVMYTLLGYIMNQINKLGGLETYQIASQNGQLKERGGDTSKLLEKWIRSSFENCPGAVALEIGSLSSGNRISRCALFRNVVRIDLEEHEGVIKQDFMERPLPRNENDKFDLISCSLVLNFVKNHRDRGAMCHRMVKFLKPQGYIFIVLPQACVTHSRYCDKTLLQNLLGSIGLIMLNSHQSNKLYYCLYQLQVVSPQPSSFSKRIKVNDGPGLNNFGITL

SEQ ID NO: 39 - protein, 215 aa, Saccharomyces cerevisiae
  misc_feature (0)...(0): Polypeptide Accession Number YBR154C
MDQENERNISRLWRAFRTVKEMVKDRGYFITQEEVELPLEDFKAKYCDSMGRPQRKMMSFQANPTEESISKFPDMGSLWVEFCDEPSVGVKTMKTFVIHIQEKNFQTGIFVYQNNITPSAMKLVPSIPPATIETFNEAALVVNITHHELVPKHIRLSSDEKRELLKRYRLKESQLPRIQRADPVALYLGLKRGEVVKIIRKSETSGRYASYRICM

SEQ ID NO: 40 - protein, 580 aa, Saccharomyces cerevisiae
  misc_feature (0)...(0): Polypeptide Accession Number YBR170C
MLIRFRSKNGTHRVSCQENDLFGTVIEKLVGNLDPNADVDTFTVCEKPGQGIHAVSELADRTVMDLGLKHGDMLILNYSDKPANEKDGVNVEIGSVGIDSKGIRQHRYGPLRIKELAVDEELEKEDGLIPRQKSKLCKHGDRGMCEYCSPLPPWDKEYHEKNKIKHISFHSYLKKLNENANKKENGSSYISPLSEPDFRINKRCHNGHEPWPRGICSKCQPSAITLQQQEFRMVDHVEFQKSEIINEFIQAWRYTGMQRFGYMYGSYSKYDNTPLGIKAVVEAIYEPPQHDEQDGLTMDVEQVKNEMLQIDRQAQEMGLSRIGLIFTDLSDAGAGDGSVFCKRHKDSFFLSSLEVIMAARHQTRHPNVSKYSEQGFFSSKFVTCVISGNLEGEIDISSYQVSTEAEALVTADMISGSTFPSMAYINDTTDERYVPEIFYMKSNEYGITVKENAKPAFPVDYLLVTLTHGFPNTDTETNSKFVSSTGFPWSNRQAMGQSQDYQELKKYLFNVASSGDFNLLHEKISNFHLLLYINSLQILSPDEWKLLIESAVKNEWEESLLKLVSSAGWQTLVMILQESG

SEQ ID NO: 41 - protein, 315 aa, Saccharomyces cerevisiae
  misc_feature (0)...(0): Polypeptide Accession Number YBR175W
MFQFVTPVGTQNGLKATCAKISPDGQFLAITQGLNILIYDINRRTVSQTLVTSHARPFSELCWSPDGQCIATASDDFSVEIIHLSYGLLHTFIGHTAPVISLTFNRKGNLLFTSSMDESIKIWDTLNGSLMKTISAHSEAVVSVDVPMNDSSILSSGSYDGLIRIFDAETGHCLKTLTYDKDWKRENGVVPISQVKFSENARYLLVKSLDGVVKIWDCIGGCVVRTFQVQPLEKGVLHHSCGMDFLNPEDGSTPLVISGYENGDIYCWNSDTKSLLQLLDGSLYHHSSPVMSIHCFGNIMCSLALNGDCCLWRWV

SEQ ID NO: 42 - protein, 312 aa, Saccharomyces cerevisiae
  misc_feature (0)...(0): Polypeptide Accession Number YBR176W
MNIMKRQLCTSSKRFFSTAKNVVKYNTIQDIRNKYFTGTPLSMCTAYDFITATWVNKANCDLLLVGDSLAMTSLGYDSTITLSLNEFKYHVASVCRAEGSSMVVVDMPFGTFESGISDGLKNAIDIMKLDSKVTSVKVEVGSYTKDKYAMKFIEELCSRGIPVMAHIGLTPQKVHSLGGYKVQGSKSLLQMQELYETAMQLQKIGCWSILIECVPHKMAQFITSKLSVPTIGIGAGNGTSGQVLVISDLLGMQGDSVPKFVKQAVNMTDIATQGLKEYIASVEDRTFPERGTHTFKVKEDLWNEFLSSINEK

SEQ ID NO: 43 - protein, 523 aa, Saccharomyces cerevisiae
  misc_feature (0)...(0): Polypeptide Accession Number YBR184W
MYQNNVLNAILASEKSNFQYDSGTILRNHKRPIITFNNNIEHTVSEPNNFTGYEEKEDLDIMDICPYYPKARMLADAIQHAKTSASENKMELSMKTIPCLKKENVHVEKGHDWSQLSTSRICKILEDIADKKNKTRRQSAPLQKTKYFPTNENQNTDIENQNWSQIPNEDICALIEKIASRRNKNRKRKNLSCSKVQEIQGNIDLPKKDVQEGDISDSSLFAAVRGTKKVSGYDYNSEDKIPNAIRLPYCKQILRLFSLLQMKRNDLIVTSENCNSGVFFSNFNYQLQVKSNCIANISSTLSFLPHHEITVYTSFILYPNVVDNIWECTRYAIQLLKSEAAQFTLLRDIYSGFTIILSNHRYHPKGFSADYCYSANELTLFLFVIRTGQKKVLYRSIPHNTAAIEKDSSFDTENRKRRSEEEVVLKCRKCSNNSLALKEISTYRLDSAEGFEKSQPLKDEAKLSDMNYVQGSISYNRTILTGLWKLFHRLCCKDRYRKTNLSETLFYDDSTERWVRMGELMHY

SEQ ID NO: 44 - protein, 140 aa, Saccharomyces cerevisiae
  misc_feature (0)...(0): Polypeptide Accession Number YBR188C
MPSLRDLSLERDQELNQLRARINQLGKTGKEEANDFVGLNISNEPVYDTVIQTGQSSNATNSFVQETIQKTKQKESGQPYIIPQKNEHQRYIDKVCETSDLKAKLAPIMEVLEKKTNEKIKGIIRKRVLQEPDRDNDDSG

SEQ ID NO: 45 - protein, 103 aa, Saccharomyces cerevisiae
  misc_feature (0)...(0): Polypeptide Accession Number YBR190W
MSLNIAFFPAARTCSEPRKSTAAKPPLMCWPTATSGRAGSPGSGGGHNTRAGKVNGLCASVKFYHQWSVMSGKDNIESSVQFQALPIELWNKRTKTKITSNNG

SEQ ID NO: 46 - protein, 223 aa, Saccharomyces cerevisiae
  misc_feature (0)...(0): Polypeptide Accession Number YBR193C
MSQSTASLVPEGNQGSLQEDVSFDFNGVPGQALDAVRMRLAQLTHSLRRIRDEMSKAELPQWYTLQSQLNVTLSQLVSVTSTLQHFQETLDSTVVYPLPKFPTTSHESLVTTLLRKKNIPEVDEWMKYVRETSGVTTALLKDEEIEKLLQQDREITNWARTTFRNEYGKHDFKNEESLSEEHASLLVRDSKPSKPFNVDDVLKFTFTGEKPIITGSTSTSSSN

SEQ ID NO: 47 - protein, 123 aa, Saccharomyces cerevisiae
  misc_feature (0)...(0): Polypeptide Accession Number YBR194W
MDQKKDPSNNLTERRVSKVQRPNKKKVRNQVESLSRNLERNKEGQLLQTVSKGHLEADSGHSLGREKENGELGIRSIFYDKDWNPRGTAPSHYRNIPYNPATFKRRTEVQARLGNLENIKIPK

SEQ ID NO: 48 - protein, 422 aa, Saccharomyces cerevisiae
  misc_feature (0)...(0): Polypeptide Accession Number YBR195C
MNQCAKDITHEASSIPIDLQERYSHWKKNTKLLYDYLNTNSTKWPSLTCQFFPDLDTTSDEHRILLSSFTSSQKPEDETIYISKISTLGHIKWSSLNNFDMDEMEFKPENSTRFPSKHLVNDISIFFPNGECNRARYLPQNPDIIAGASSDGAIYIFDRTKHGSTRIRQSKISHPFETKLFGSHGVIQDVEAMDTSSADINEATSLAWNLQQEALLLSSHSNGQVQVWDIKQYSHENPIIDLPLVSINSDGTAVNDVTWMPTHDSLFAACTEGNAVSLLDLRTKKEKLQSNREKHDGGVNSCRFNYKNSLILASADSNGRLNLWDIRNMNKSPIATMEHGTSVSTLEWSPNFDTVLATAGQEDGLVKLWDTSCEETIFTHGGHMLGVNDISWDAHDPWLMCSVANDNSVHIWKPAGNLVGHS

SEQ ID NO: 49 - protein, 554 aa, Saccharomyces cerevisiae
  misc_feature (0)...(0): Polypeptide Accession Number YBR196C
MSNNSFTNFKLATELPAWSKLQKIYESQGKTLSVKQEFQKDAKRFEKLNKTFTNYDGSKILFDYSKNLVNDEIIAALIELAKEANVTGLRDAMFKGEHINSTEDRAVYHVALRNRANKPMYVDGVNVAPEVDSVLKHMKEFSEQVRSGEWKGYTGKKITDVVNIGIGGSDLGPVMVTEALKHYAGVLDVHFVSNIDGTHIAETLKVVDPETTLFLIASKTFTTAETITNANTAKNWFLSKTGNDPSHIAKHFAALSTNETEVAKFGIDTKNMFGFESWVGGRYSVWSAIGLSVALYIGYDNFEAFLKGAEAVDNHFTQTPLEDNIPLLGGLLSVWYNNFFGAQTHLVAPFDQYLHRFPAYLQQLSMESNGKSVTRGNVFTDYSTGSILFGEPATNAQHSFFQLVHQGTKLIPSDFILAAQSHNPIENKLHQKMLASNFFAQAEALMVGKDEEQVKAEGATGGLVPHKVFSGNRPTTSILAQKITPATLGALIAYYEHVTFTEGAIWNINSFDQWGVELGKVLAKVIGKELDNSSTISTHDASTNGLINQFKEWM

SEQ ID NO: 50 - protein, 404 aa, Saccharomyces cerevisiae
  misc_feature (0)...(0): Polypeptide Accession Number YBR205W
MSVHHKKKLMPKSALLIRKYQKGIRSSFIGLIIVLSFLFFMSGSRSPEVPIAQGTSVSRVASKDYLMPFTDKSQGVIHPVDDGKKEKGVMVTLARNSDLWNLVKSIRHVEDRFNNRYHYDWVFLNDQPFSDEFKRVTSALVSGKAKYGTIPKDHWSIPSWIDTEKFDEKRLAMGKLDIPYGSSVPYRHMCRFQSGFIWRHPLLEEYEWFWRVDTDITLFCDIQYDIFKFLKVNNKKYGFILSVSEYERTIPTLWETTKKFIKKNPKFLHKNNLMKFISNDDGDTYNMCHFWTNFEIGSLDFFRSDAYREYFDYLDSSGGFFYERWGDAPVHSIAASLFLDKSEIHFFDGLGFHHPDFTSCPIEQKIRLQNKCICEPSKDVTWTPDYFCTRKYFSAGNYKLPPGI

SEQ ID NO: 51 - protein, 186 aa, Saccharomyces cerevisiae
  misc_feature (0)...(0): Polypeptide Accession Number YBR217W
MSRILESENETESDESSIISTNNGTAMERSRNNQELRSSPHTVQNRLELFSRRLSQLGLASDISVDQQVEDSSSGTYEQEETIKTNAQTSKQKSHKDEKNIQKIQIKFQPIGSIGQLKPSVCKISMSQSFAMVILFLKRRLKMDHVYCYINNSFAPSPQQNIGELWMQFKTNDELIVSYCASVAFG

SEQ ID NO: 52 - protein, 366 aa, Saccharomyces cerevisiae
  misc_feature (0)...(0): Polypeptide Accession Number YBR221C
MFSRLPTSLARNVARRAPTSFVRPSAAAAALRFSSTKTMTVREALNSAMAEELDRDDDVFLIGEEVAQYNGAYKVSKGLLDRFGERRVVDTPITEYGFTGLAVGAALKGLKPIVEFMSFNFSMQAIDHVVNSAAKTHYMSGGTQKCQMVFRGPNGAAVGVGAQHSQDFSPWYGSIPGLKVLVPYSAEDARGLLKAAIRDPNPVVFLENELLYGESFEISEEALSPEFTLPYKAKIEREGTDISIVTYTRNVQFSLEAAEILQKKYGVSAEVINLRSIRPLDTEAIIKTVKKTNHLITVESTFPSFGVGAEIVAQVMESEAFDYLDAPIQRVTGADVPTPYAKELEDFAFPDTPTIVKAVKEVLSIE

SEQ ID NO: 53 - protein, 304 aa, Saccharomyces cerevisiae
  misc_feature (0)...(0): Polypeptide Accession Number YBR228W
MSQKIQQHQFPDFYCCYLLQSINKRQSFYVGSTPNPVRRLRQHNGKLAVGGAYRTKRDGSRPWEMIMIVRGFPSKIAALQFEHAWQHGYQTHYIAEKDRVVKHKAGGRTLHHKVALMKLLLKHEFFQRMNLIVEVFNIKAWEVWKQDKFFIERDRFPINIQINENALEEPKEKTVDVLMDHSDENLKVVEAVYTKVIENERNIFETFEKKLTTGVVRCEICEKEIDYTSEEQNLKPFVALCNNKDCGCVNHLKCLHRYFLDDEQLMVGRRNLIPRGGKCPKCDMFCDWTTLVKFSTRMKLAHGK

SEQ ID NO: 54 - protein, 849 aa, Saccharomyces cerevisiae
  misc_feature (0)...(0): Polypeptide Accession Number YBR237W
METIDSKQNINRESLLEERRKKLAKWKQKKAQFDAQKEHQTSRNDIVTNSLEGKQTTEKFTERQERVKEELRKRKNEFRKSDEPVSVKPSKKKSKRSKVKKKISFDFSDDDDSEIGVSFRSKEHIQKAPEHDNEKDPLDEFMTSLKEEKMSNSKGMYDRGDILDVEDQLFELGGTDDEDVEDNTDNSNIAKIAKLKAKKRVKQIYYSPEELEPFQKNFYIESETVSSMSEMEVEELRLSLDNIKIKGTGCPKPVTKWSQLGLSTDTMVLITEKLHFGSLTPIQSQALPAIMSGRDVIGISKTGSGKTISYLLPLLRQVKAQRPLSKHETGPMGLILAPTRELALQIHEEVTKFTEADTSIRSVCCTGGSEMKKQITDLKRGTEIVVATPGRFIDILTLNDGKLLSTKRITFVVMDEADRLFDLGFEPQITQIMKTVRPDKQCVLFSATFPNKLRSFAVRVLHSPISITINSKGMVNENVKQKFRICHSEDEKFDNLVQLIHERSEFFDEVQSENDGQSSDVEEVDAKAIIFVSSQNICDFISKKLLNAGIVTCAIHAGKPYQERLMNLEKFKREKNSILLCTEVLSRGLNVPEVSLVIIYNAVKTFAQYVHTTGRTARGSRSGTAITLLLHDELSGAYILSKAMRDEEIKALDPLQAKELQEMSAKFESGMKKGKFRLSKGFGGKGLENIKSKREEAQNKDLELKKNDKRSDDLEKKISNPREGHDSVSESSALIPRLNYELFKESTDGSIIFYAKVYINDLPQIVRWEATKNTTLLFIKHETGCSITNKGKFYPEGKEPKNENDEPKLYLLIEGQDEKDIQLSIELLEQKVKEGVVKAASLSLKSTKY

SEQ ID NO: 55 - protein, 162 aa, Saccharomyces cerevisiae
  misc_feature (0)...(0): Polypeptide Accession Number YBR244W
MTTSFYDLECKDKKGESFKFDQLKGKVVLIVNVASKCGFTPQYKELEELYKKYQDKGFVILGFPCNQFGKQEPGSDEQITEFCQLNYGVTFPIMKKIDVNGSNADSVYNYLKSQKAGLLGFKGIKWNFEKFLVDSNGKVVQRFSSLTKPSSLDQEIQSLLSK

SEQ ID NO: 56 - protein, 147 aa, Saccharomyces cerevisiae
  misc_feature (0)...(0): Polypeptide Accession Number YBR252W
MTATSDKVLKIQLRSASATVPTKGSATAAGYDIYASQDITIPAMGQGMVSTDISFTVPVGTYGRIAPRSGLAVKNGIQTGAGVVDRDYTGEVKVVLFNHSQRDFAIKKGDRVAQLILEKIVDDAQIVVVDSLEESARGAGGFGSTGN

SEQ ID NO: 57 - protein, 121 aa, Saccharomyces cerevisiae
  misc_feature (0)...(0): Polypeptide Accession Number YBR253W
MSNQALYEKLEQTRTILSVKLAELINMTTIADRNDDDEGSFAQENSELAVATTSVMMVNNQTMQLIKNVQDLLILTRSIKEKWLLNQIPVTEHSKVTRFDEKQIEELLDNCIETFVAEKTT

SEQ ID NO: 58 - protein, 175 aa, Saccharomyces cerevisiae
  misc_feature (0)...(0): Polypeptide Accession Number YBR254C
MPQYFAIIGKKDNPVYEIEFTNAENPQGFPQDLKELNPFILHASLDIVEDLQWQINPTSQLNGNGGNGSNGGGGFLRSRAVNNTDNCYLGKVDHFYGLAITAYISYSGMKFVMIHGNSANSSVVIDDNNMRSFYQEVHELYVKTLMNPFYKITDPIRSPAFDSRVRTLARKHLSK

SEQ ID NO: 59 - protein, 545 aa, Saccharomyces cerevisiae
  misc_feature (0)...(0): Polypeptide Accession Number YBR270C
MATDLNRKRSATSGSLSVTNPNIKATNRKPARVYSVSSDIVPQALTHPDEDVHLKTSKSPHDAAPRWSQVGFQSIFHDGSNARRSTDSIEEEYSQGTENNDGHSEIGSSSSNRMEGNTTSNDSLFSSNSRGNKRRLSIFTNSKDNMRNRSRRASKNYGTVITGTSSNNISRSGSKLFHTKSNMSVNSLQSSLSTGHSHSNKGSNVFSKMAKKLLPYKPHNSIGKDDVEPVVPSPFSKFLHSSYGKHRSPVQFIHTSTGGLIDSGKSVYSFNPSINNNPNDTALSLIQDDAFDATNVSLLHDLLKNLPSLIANYKSFTVQELFVLEGNIWGIYCSIVVELFKNKRVWQLPAKIEDIDRLLEFYITLKTQTKAAVTHSRFLAEIEEFITTSLYILENQIVFNYANEDTVNTALKRVGIIWKVFYQQVYYDMMAVLLPFEKSFQKNSNYWLDGYLSEPSRYAPSIDVLLLKCFRDSIILPYYESFLHTNDGASKSFQRYIFSEEEQNGVTEEDKLTLLQCFGILNTIKGNSRNQRIIGELLEGIRMSI

SEQ ID NO: 60 - protein, 527 aa, Saccharomyces cerevisiae
  misc_feature (0)...(0): Polypeptide Accession Number YBR274W
MSLSQVSPLPHIKDVVLGDTVGQGAFACVKNAHLQMDPSIILAVKFIHVPTCKKMGLSDKDITKEVVLQSKCSKHPNVLRLIDCNVSKEYMWIILEMADGGDLFDKIEPDVGVDSDVAQFYFQQLVSAINYLHVECGVAHRDIKPENILLDKNGNLKLADFGLASQFRRKDGTLRVSMDQRGSPPYMAPEVLYSEEGYYADRTDIWSIGILLFVLLTGQTPWELPSLENEDFVFFIENDGNLNWGPWSKIEFTHLNLLRKILQPDPNKRVTLKALKLHPWVLRRASFSGDDGLCNDPELLAKKLFSHLKVSLSNENYLKFTQDTNSNNRYISTQPIGNELAELEHDSMHFQTVSNTQRAFTSYDSNTNYNSGTGMTQEAKWTQFISYDIAALQFHSDENDCNELVKRHLQFNPNKLTKFYTLQPMDVLLPILEKALNLSQIRVKPDLFANFERLCELLGYDNVFPLIINIKTKSNGGYQLCGSISIIKIEEELKSVGFERKTGDPLEWRRLFKKISTICRDIILIPN

SEQ ID NO: 61 - protein, 878 aa, Saccharomyces cerevisiae
  misc_feature (0)...(0): Polypeptide Accession Number YBR281C
MYDSRGVALHSELIHRWNHAFSILSIVAFPKKRLLFAGSQDSKILVFDLPTYNLIHTIRLGESQEETHTRSSVLCLTGSEDENFLFSGGADSLVRIWSIGEKTIRDDFLPVTEIATVYSVTDIGDIFSLAYLDSLETIVFGCQNASLLYVENLIQKIEKKSSDGVENINKLPHRRYDKFFDSLGPTGYSSNSLSQTSLTSLQENCGAAIIEVPSENIIKYAHYGFIYSINKLCPRFNQLLEKSSRTSGAEHIISSAGDGISKLWEFSKDKGQNTVKISLINDKIDNEDSVISQTIEFPFLYCGLTDGIIKIWDLNTQQIISTLKTKHESDVISISVYMDHVFAIDESGITHFYQNQVNHWNPQQGKILSSEIFSKSNAGSVSLLTGGSDGSLTLWDITSLLSAVPLSSNSPINASSTLQTTNLWAAYQSASLNNEEMLNTLRELISFQTVSQSKDTTNTLSLRRCAIYLQQLFLKFGATNSQLFPLPDGGNPVVFAYFQGNGKVSQVKGAKKKRILWYGHYDVISSGNTFNWNTDPFTLTCENGYLKGRGVSDNKGPLVSAIHSVAYLFQQGELVNDVVFLVEGSEEIGSASLKQVCEKYHDIIGKDIDWILLSNSTWVDQEHPCLNYGLRGVINAQIKVWSDKPDGHSGLNGGVYDEPMVNLVKIVSKLQNEQNEIMIPNFYSPLKDLTEEEYQRFQKITELANIDENTTVQDLITNWTKPSLSMTTVKFSGPGNITVIPKSVTMGISIRLVPEQSVEQVKRDLKAYLEESFKQLKSQNHLEIKVLNEAEGWLGDPTNHAYQILKDEITTAWDVEPLLVREGGSISCLRMLERIFDAPAVQIPCGQSTDNGHLANENLRIKNWSNLTEILSKVFNRL

SEQ ID NO: 62 - protein, 438 aa, Saccharomyces cerevisiae
  misc_feature (0)...(0): Polypeptide Accession Number YCL020W
MESQQLHQNPRSLHGSAYASVTSKEVPSNQDPLAVSASNLPEFDRDSTKVNSQQETTPGTSAVPENHHHVSPQPASVPPPQNGQYQQHGMMTPNKAMASNWAHYQQPSMMTCSHYQTSPAYYQPDPHYPLPQYIPPLSTSSPDPIDSQNQHSEVPQAETKVRNNVLPPHTLTSDENFSTWVKFYIRFLKNSNLGDIIPNDQGEIKRQMTYEEHAYIYNTFQAFAPFHLLPTWVKQILEINYADILTVLCKSVSKMQTNNQELKDWIALANLEYDGSTSADTFEITVSTIIQRLKENNINVSDRLACQLILKGLSGDFKYLRNQYRTKTNMKLSQLFAEIQLIYDENKIMNLNKPSQYKQHSEYKNVSRTSPNTTNTKVTTRNYQRTNSSKPRAAKAHNIATSSKFSRVNNDHINESTVSSQYLSDDNELSLRPATERI

SEQ ID NO: 63 - protein, 915 aa, Saccharomyces cerevisiae
  misc_feature (0)...(0): Polypeptide Accession Number YCL024W
MTVANTETHSAAKPSSTIGPWKLGETLGFGSTGKVQLAQHERTGHRTAVKVISKSIFNNNGNHSNDDSVLPYNIEREIVIMKLLSHPNVLSLYDVWETNNNLYLILEYAEKGELFNLLVDHGPLPEREAINCFRQIIIGISYCHALGIVHRDLKPENLLLDSFYNIKIADFGMAALQTDADLLETSCGSPHYAAPEIVSGLPYEGFASDVWSCGVILFALLTGRLPFDEENGNVRDLLLKVQKGQFEMPNDTEISRDAQDLIGKILVVDPRQRIKIRDILSHPLLKKYQTIKDSKSIKDLPRENTYLYPLADSNNHTSASIDDSILQNLVVLWHGRHADDIVSKLKENGTNKEKILYALLYRFKLDSVRGSNKKNRNKIKKTKKNKRSSTLSSSSSLLLNNRSIQSTPRRRTSKRHSREFSSSRKRSSFLLSSNPTDSSPIPLRSSKRITHINVASANTQATPSGVPNPHKRNSKKRSSKRLSYMPNTKRSSLTSKSLSNFTNLIDDDDWEYIEKDAKRTSSNFATLIDEIFEPEKFELAKREKAELQRKVQEAKRQSVNAQKINEDEFGSEVSDGMKELKKINDKVSSPLINYEFSQQELLQDIDTLLTNRYQLSSYTRPISRLDPGLTPVTETLPNNLKEKTALLQDTEKKIIETIRRSKFLGSLLNVRGGLSPGKSELAPIEESPIVSTTPLIYNDRMEPRRISDVEVPHFTRKSKHFTTANNRRSVLSLYAKDSIKDLNEFLIKEDPDLPPQGSTDNESRSEDPEIAESITDSRNIQYDEDDSKDGDNVNNDNILSDFPQGVGISQEYDMKDKNPNQSPISKSAEPTLVVKLPSLSSFQGKNASGLGLYQREPSKVTLPSLTSNNSSVGENIEDGAEKGTESEKIAASLSDDDLKEDNDKKDNDTVNALLQ

SEQ ID NO: 64 - protein, 346 aa, Saccharomyces cerevisiae
  misc_feature (0)...(0): Polypeptide Accession Number YCL032W
MEDGKQAINEGSNDASPDLDVNGTILMNNEDFSQWSVDDVITWCISTLEVEETDPLCQRLRENDIVGDLLPELCLQDCQDLCDGDLNKAIKFKILINKMRDSKLEWKDDKTQEDMITVLKNLYTTTSAKLQEFQSQYTRLRMDVLDVMKTSSSSSPINTHGVSTTVPSSNNTIIPSSDGVSLSQTDYFDTVHNRQSPSRRESPVTVFRQPSLSHSKSLHKDSKNKVPQISTNQSHPSAVSTANTPGPSPNEALKQLRASKEDSCERILKNAMKRHNLADQDWRQYVLVICYGDQERLLELNEKPVIIFKNLKQQGLHPAIMLRRRGDFEEVAMMNGSDNVTPGGRL

SEQ ID NO: 65 - protein, 500 aa, Saccharomyces cerevisiae
  misc_feature (0)...(0): Polypeptide Accession Number YCL040W
MSFDDLHKATERAVIQAVDQICDDFEVTPEKLDELTAYFIEQMEKGLAPPKEGHTLASDKGLPMIPAFVTGSPNGTERGVLLAADLGGTNFRICSVNLHGDHTFSMEQMKSKIPDDLLDDENVTSDDLFGFLARRTLAFMKKYHPDELAKGKDAKPMKLGFTFSYPVDQTSLNSGTLIRWTKGFRIADTVGKDVVQLYQEQLSAQGMPMIKVVALTNDTVGTYLSHCYTSDNTDSMTSGEISEPVIGCIFGTGTNGCYMEEINKITKLPQELRDKLIKEGKTHMIINVEWGSFDNELKHLPTTKYDVVIDQKLSTNPGFHLFEKRVSGMFLGEVLRNILVDLHSQGLLLQQYRSKEQLPRHLTTPFQLSSEVLSHIEIDDSTGLRETELSLLQSLRLPTTPTERVQIQKLVRAISRRSAYLAAVPLAAILIKTNALNKRYHGEVEIGCDGSVVEYYPGFRSMLRHALALSPLGAEGERKVHLKIAKDGSGVGAALCALVA

SEQ ID NO: 66 - protein, 107 aa, Saccharomyces cerevisiae
  misc_feature (0)...(0): Polypeptide Accession Number YCL046W
MVKGKTFLKRICPEETLNEETKQEVSVGFDKMRTLLRSRESGMTFSQGPKLASCQSVINASSEKTAWTQLVFRKSKMKTYTKSVHVIFIAMGEGEDESVDMNVGISY

SEQ ID NO: 67 - protein, 841 aa, Saccharomyces cerevisiae
  misc_feature (0)...(0): Polypeptide Accession Number YCL054W
MGKTQKKNSKGRLDRYYYLAKEKGYRARSSFKIIQINEKYGHFLEKSKVVIDLCAAPGSWCQVASKLCPVNSLIIGVDIVPMKPMPNVITFQSDITTEDCRSKLRGYMKTWKADTVLHDGAPNVGLGWVQDAFTQSQLTLQALKLAVENLVVNGTFVTKIFRSKDYNKLIWVFQQLFEKVEATKPPASRNVSAEIFVVCKGFKAPKRLDPRLLDPKEVFEELPDGQQNMESKIYNPEKKVRKRQGYEEGDNLLYHETSILDFVRTEDPISMLGEMNKFTIDENDHEWKILKKLKQTTDEFRSCIEDLKVLGKKDFKMILRWRKIAREILGIEVKDDAKTEIEVVPLTEEEQIEKDLQGLQEKQRLNVKRERRRKNEMKQKELQRMQMNMITPTDIGIEAASLGKESLFNLKTAEKTGILNDLAKGKKRMIFTDDELAKDNDIYIDENIMIKDKDSAADADDLESELNAMYSDYKTRRSERDAKFRAKQARGGDNEEEWTGFNEGSLEKKEEEGKDYIEDNDDEGVEGDSDDDEAITNLISKLKGQEGDHKLSSKARMIFNDPIFNNVEPDLPVNTVNDGIMSSESVGDISKLNKKRKHEEMHQKQDEADSSDESSSDDSDFEIVANDNASEEFDSDYDSEEEKNQTKKEKHSRDIDIATVEAMTLAHQLALGQKNKHDLVDEGFNRYTFRDTENLPDWFLEDEKEHSKINKPITKEAAMAIKEKIKAMNARPIKKVAEAKARKRMRAVARLEKIKKKAGLINDDSDKTEKDKAEEISRLMRKVTKKPKTKPKVTLVVASGRNKGLAGRPKGVKGKYKMVDGVMKNEQRALRRIAKKHHKKK

SEQ ID NO: 68 - protein, 335 aa, Saccharomyces cerevisiae
  misc_feature (0)...(0): Polypeptide Accession Number YCL055W
MAFQDPTYDQNKSRHINNSHLQGPNQETIEMKSKHVSFKPSRDFHTNDYSNNYIHGKSLPQQHVTNIENRVDGYPKLQKLFQAKAKQINQFATTPFGCKIGIDSIVPTLNHWIQNENLTFDVVMIGCLTENQFIYPILTQLPLDRLISKPGFLFIWANSQKINELTKLLNNEIWAKKFRRSEELVFVPIDKKSPFYPGLDQDDETLMEKMQWHCWMCITGTVRRSTDGHLIHCNVDTDLSIETKDTTNGAVPSHLYRIAENFSTATRRLHIIPARTGYETPVKVRPGWVIVSPDVMLDNFSPKRYKEEIANLGSNIPLKNEIELLRPRSPVQKAQ

SEQ ID NO: 69 - protein, 316 aa, Saccharomyces cerevisiae
  misc_feature (0)...(0): Polypeptide Accession Number YCL059C
MVSTHNRDKPWDTDDIDKWKIEEFKEEDNASGQPFAEESSFMTLFPKYRESYLKTIWNDVTRALDKHNIACVLDLVEGSMTVKTTRKTYDPAIILKARDLIKLLARSVPFPQAVKILQDDMACDVIKIGNFVTNKERFVKRRQRLVGPNGNTLKALELLTKCYILVQGNTVSAMGPFKGLKEVRRVVEDCMKNIHPIYHIKELMIKRELAKRPELANEDWSRFLPMFKKRNVARKKPKKIRNVEKKVYTPFPPAQLPRKVDLEIESGEYFLSKREKQMKKLNEQKEKQMEREIERQEERAKDFIAPEEEAYKPNQN

SEQ ID NO: 70 - protein, 247 aa, Saccharomyces cerevisiae
  misc_feature (0)...(0): Polypeptide Accession Number YCR004C
MVKIAIITYSTYGHIDVLAQAVKKGVEAAGGKADIYRVEETLPDEVLTKMNAPQKPEDIPVATEKTLLEYDAFLFGVPTRFGNLPAQWSAFWDKTGGLWAKGSLNGKAAGIFVSTSSYGGGQESTVKACLSYLAHHGIIFLPLGYKNSFAELASIEEVHGGSPWGAGTLAGPDGSRTASPLELRIAEIQGKTFYETAKKLFPAKEAKPSTEKKTTTSDAAKRQTKPAAATTAEKKEDKGLLSCCTVM

SEQ ID NO: 71 - protein, 265 aa, Saccharomyces cerevisiae
  misc_feature (0)...(0): Polypeptide Accession Number YCR009C
MSWEGFKKAINRAGHSVIIKNVDKTIDKEYDMEERRYKVLQRAGEALQKEAKGFLDSLRAVTASQTTIAEVISNLYDDSKYVAGGGYNVGNYYLQCVQDFDSETVKQLDGPLRETVLDPITKFSTYFKEIEEAIKKRDHKKQDFDAAKAKVRRLVDKPAKDASKLPRAEKELSLAKDIFENLNNQLKTELPQLVSLRVPYFDPSFEALIKIQLRFCTDGYTRLAQIQQYLDQQSRDDYANGLLDTKIEELLGQMTSLDICALGIK

SEQ ID NO: 72 - protein, 1049 aa, Saccharomyces cerevisiae
  misc_feature (0)...(0): Polypeptide Accession Number YCR011C
MGSHRRYLYYSILSFLLLSCSVVLAKQDETPFFEGTSSKNSRLTAQDKGNDTCPPCFNCMLPIFECKQFSECNSYTGRCECIEGFAGDDCSLPLCGGLSPDESGNKDRPIRAQNDTCHCDNGWGGINCDVCQEDFVCDAFMPDPSIKGTCYKNGMIVDKVFSGCNVTNEKILQILNGKIPQITFACDKPNQECNFQFWIDQLESFYCGLSDCAFEYDLEQNTSHYKCNDVQCKCVPDTVLCGAKGSIDISDFLTETIKGPGDFSCDLETRQCKFSEPSMNDLILTVFGDPYITLKCESGECVHYSEIPGYKSPSKDPTVSWQGKLVLALTAVMVLALFTFATFYISKSPLFRNGLGSSKSPIRLPDEDAVNNFLQNEDDTLATLSFENITYSVPSINSDGVEETVLNEISGIVKPGQILAIMGGSGAGKTTLLDILAMKRKTGHVSGSIKVNGISMDRKSFSKIIGFVDQDDFLLPTLTVFETVLNSALLRLPKALSFEAKKARVYKVLEELRIIDIKDRIIGNEFDRGISGGEKRRVSIACELVTSPLVLFLDEPTSGLDASNANNVIECLVRLSSDYNRTLVLSIHQPRSNIFYLFDKLVLLSKGEMVYSGNAKKVSEFLRNEGYICPDNYNIADYLIDITFEAGPQGKRRRIRNISDLEAGTDTNDIDNTIHQTTFTSSDGTTQREWAHLAAHRDEIRSLLRDEEDVEGTDGRRGATEIDLNTKLLHDKYKDSVYYAELSQEIEEVLSEGDEESNVLNGDLPTGQQSAGFLQQLSILNSRSFKNMYRNPKLLLGNYLLTILLSLFLGTLYYNVSNDISGFQNRMGLFFFILTYFGFVTFTGLSSFALERIIFIKERSNNYYSPLAYYISKIMSEVVPLRVVPPILLSLIVYPMTGLNMKDNAFFKCIGILILFNLGISLEILTIGIIFEDLNNSIILSVLVLLGSLLFSGLFINTKNITNVAFKYLKNFSVFYYAYESLLINEVKTLMLKERKYGLNIEVPGATILSTFGFVVQNLVFDIKILALFNVVFLIMGYLALKWIVVEQK

SEQ ID NO: 73 - protein, 88 aa, Saccharomyces cerevisiae
  misc_feature (0)...(0): Polypeptide Accession Number YCR020C-A
MDILKLSDFIGNTLIVSLTEDRILVGSLVAVDAQMNLLLDHVEERMGSSSRMMGLVSVPRRSVKTIMIDKPVLQELTANKVELMANIV

SEQ ID NO: 74 - protein, 114 aa, Saccharomyces cerevisiae
  misc_feature (0)...(0): Polypeptide Accession Number YCR022C
MENRCSNPCYIQSDPSDLLSLRLPARFCWPFSRSSRIFQGSSRRRILSEGKNASKACFVRIFGMAKVSKAISRSRSRLLFRSLPPHPACLFEYQISSSSLFHHPFLLWQGQVFF

SEQ ID NO: 75 - protein, 611 aa, Saccharomyces cerevisiae
  misc_feature (0)...(0): Polypeptide Accession Number YCR023C
MARQKLTFKEQMDGFPWVQLVVVSLVRFSEPIAFSSLFPYVYFMVRDFNIAPNDAQVSKYSGYLSSSFALCQVISAYHWGRFSEKHGRKITLTCGLIGTSVSLLILGFSHNFYQALVARSLMGLLNGNVGVIRTIIGEIATERKHQALAFSTMPLLFQFGAVVGPMIGGFLVFRDGTMNEVPLWFPHFAKRIIRSYPYALPNVVVCMFLMFGLTNATLFLEETHPAFKNRRDYGLEVGDFIKKNIFGIQPKRRPWQKRIQDDSENIHHRNENVNSNRGQDSEEDENSPLVNTTNDDDTESIQSIDPILTRRQSVGLIRTYSLHEPTDAVHANIDTAPDGCKESSIFHHVFHTKVFYPISVNFIMALHLIVYNEFLPVFLAYDLAVDPENPKKLASKFPWKISGGIGYEPEQTGTLLSTTGIFGCFVVIFIFPIVDRNFDCLTIFRTLVKLYPIMYVMVPYVVFLQNERIPSWYTVVYLYIITGIKTFCGALTSPQIMLLIHNSSPLSCRSVINGATISISASARFIGPLVWGYIMSWSQQNDVAWVSWWSLSLFCMVALYQSYKIAPIDDNENELHGQGSEDAYNSQSQSSDLRMAHRSSLSSLSNQRCTT

SEQ ID NO: 76 - protein, 209 aa, Saccharomyces cerevisiae
  misc_feature (0)...(0): Polypeptide Accession Number YCR027C
MEYATMSSSNSTHNFQRKIALIGARNVGKTTLTVRFVESRFVESYYPTIENEFTRIIPYKSHDCTLEILDTAGQDEVSLLNIKSLTGVRGIMLCYSIINRASFDLIPILWDKLVDQLGKDNLPVILVGTKADLGRSTKGVKRCVTKAEGEKLASTIGSQDKRNQAAFIECSAELDYNVEETFMLLLKQMERVEGTLGLDAENNNKCSIM

SEQ ID NO: 77 - protein, 870 aa, Saccharomyces cerevisiae
  misc_feature (0)...(0): Polypeptide Accession Number YCR030C
MTEQRTKYADSILTTKSPYEATETIRIRLSQVKLLNKDFYLLFKELANLKRNYAQQLRKIIAENEDITKILNAQMIESNVLTPQEMSAFRFNSLGELRNVWDTVIEELKSDLKSSTEYYNTLDQQVVRELKESVENNTSWRESKDLHSKLSKNAASIEHYSKNNENSSHLEEARRQWDQQSPYLFELFETIDYNRLDTLKNCMLRFQTSFSDYLLNTTKECETVMTKFLAFEPQSEIDRFAKDASQYNFQLSSSSKEVVPNNASPASATGARPVSVSNGAANTEREKKSPQKDKRKSAFGNIGHRLASASSSLTHNDLMNNEFSDSTNNSSLKSKKSSHTLRSKVGSIFGRNKTKNKRQQQSSSNSHIQASITETPNNSSTRVSSTATSSIYQKQRRPTYSSSKSNNWTPGEASDTPPLPPHATPKNVDAPVTADTPPAQTFTPSEVPPSTPQQSSPPTAKEPDSSNLPKTVPISISQPPLQPQSKTKPLPVEPASPSISLPTATVDNQPSGQVDSRPLHIRAPALPPSRKQNFIHNRDSQLYDSLPNHGSGATPTSSSLSSIPQERPVSTLSSQITGELRELNPQATGSSTSLVGQSLFQHSSLDTSQFGLNASIAEVLNASFKDGMLQNSQLIGEIALNYLPNSVMNSPLPIGINLRINNGAKFEKVILNQAFIERVAPEEFKVNPSFIDSRTLGAIKYSIKEPIAPIVIHPVWRFESHQASVVLTVKMSPSLPDEISQIVIEDLVVFVNIDGANATSALSKPQGSFSKEKKRITWRFKEPVVLTRNGEGQRLIARFITDGLAHESAKGVITKFTISETDNAALPHSGSGSGITLTCQELDENNPFGGEWLDVNTKRTLTTGNYHGLA

SEQ ID NO: 78 - protein, 491 aa, Saccharomyces cerevisiae
  misc_feature (0)...(0): Polypeptide Accession Number YCR045C
MKPQCILISLLVNLAYAEEYLVRFKNPTAFQQFTSNSNRSWRQFIDNKIEKKFSIGSFRGVTMNLSKNLVNKLKKSPLVADIVPNFRFEAFEGDSVNSAESSYTFNATAKYSYEDVEEEQNITYQPDAPRHLARISRHYQLPFDVGDKDRYKSWFNYYYEHDYQGQDVNAYIMDTGIFADHPEFEDRVIQGIDLTKEGFGDQNGHGTHVAGLVGSKTYGAAKRVNLVEVKVLGKDGSGEASNVLSGLEFIVEHCTKVSRPQGKKCVANLSLGSFRSPIINMAVEGAIEEGIVFVAAAGNFNLDAYWASPASAENVITVGAFDDHIDTIAKFSNWGPCVNIFAPGVEIESLSHLNYNDTLILSGTSMSTPIVTGVAAILLSKGIEPEMIAQEIEYLSTRNVFHRRTLFFKPSTPNQILYNGVDKLDDPYDDETFPRLNIEAIAKELEEYNATLQTPMSENLQSGSKLWGWNNDVTLPLGEIRLKRRDFMKNL

SEQ ID NO: 79 - protein, 102 aa, Saccharomyces cerevisiae
  misc_feature (0)...(0): Polypeptide Accession Number YCR050C
MVAVHKVRYNVIMILGPEQTPNEKTTLDNCGLARRNLVLLKAVHTNCDSWNMNRYPLTLLKMANMAISWNTALKKKVNNVAWLLLKCNAPMELWYTCLSKNL

SEQ ID NO: 80 - protein, 923 aa, Saccharomyces cerevisiae
  misc_feature (0)...(0): Polypeptide Accession Number YCR057C
MKSDFKFSNLLGTVYRQGNITFSDDGKQLLSPVGNRVSVFDLINNKSFTFEYEHRKNIAAIDLNKQGTLLISIDEDGRAILVNFKARNVLHHFNFKEKCSAVKFSPDGRLFALASGRFLQIWKTPDVNKDRQFAPFVRHRVHAGHFQDITSLTWSQDSRFILTTSKDLSAKIWSVDSEEKNLAATTFNGHRDYVMGAFFSHDQEKIYTVSKDGAVFVWEFTKRPSDDDDNESEDDDKQEEVDISKYSWRITKKHFFYANQAKVKCVTFHPATRLLAVGFTSGEFRLYDLPDFTLIQQLSMGQNPVNTVSVNQTGEWLAFGSSKLGQLLVYEWQSESYILKQQGHFDSTNSLAYSPDGSRVVTASEDGKIKVWDITSGFCLATFEEHTSSVTAVQFAKRGQVMFSSSLDGTVRAWDLIRYRNFRTFTGTERIQFNCLAVDPSGEVVCAGSLDNFDIHVWSVQTGQLLDALSGHEGPVSCLSFSQENSVLASASWDKTIRIWSIFGRSQQVEPIEVYSDVLALSMRPDGKEVAVSTLKGQISIFNIEDAKQVGNIDCRKDIISGRFNQDRFTAKNSERSKFFTTIHYSFDGMAIVAGGNNNSICLYDVPNEVLLKRFIVSRNMALNGTLEFLNSKKMTEAGSLDLIDDAGENSDLEDRIDNSLPGSQRGGDLSTRKMRPEVRVTSVQFSPTANAFAAASTEGLLIYSTNDTILFDPFDLDVDVTPHSTVEALREKQFLNALVMAFRLNEEYLINKVYEAIPIKEIPLVASNIPAIYLPRILKFIGDFAIESQHIEFNLIWIKALLSASGGYINEHKYLFSTAMRSIQRFIVRVAKEVVNTTTDNKYTYRFLVSTDGSMEDGAADDDEVLLKDDADEDNEENEENDVVMESDDEEGWIGFNGKDNKLPLSNENDSSDEEENEKELP

SEQ ID NO: 81 - protein, 258 aa, Saccharomyces cerevisiae
  misc_feature (0)...(0): Polypeptide Accession Number YCR059C
MDDDHEQLVEELEAVEAIYPDLLSKKQEDGSIIVVKVPQHEYMTLQISFPTHYPSEEAPNVIEVGVCTSLAKRDLYDTKYLQHLFQEVMDSVFHRGSVCLFDFLTELDGVLYVEPEEETEPVQQSDIPTDPFEGWTASDPITDRGSTFMAFAAHVTSEEQAFAMLDLLKTDSKMRKANHVMSAWRIKQDGSAATYQDSDDDGETAAGSRMLHLITIMDVWNVIVVVARWFGGAHIGPDRFKHINSTAREAVVRAGFDS

SEQ ID NO: 82 - protein, 157 aa, Saccharomyces cerevisiae
  misc_feature (0)...(0): Polypeptide Accession Number YCR063W
MPRIKTRRSKPAPDGFEKIKPTLTDFEIQLRDAQKDKSSKLAAKSNEQLWEIMQLHHQRSRYIYTLYYKRKAISKDLYDWLIKEKYADKLLIAKWRKTGYEKLCCLRCIQKNETNNGSTCICRVPRAQLEEEARKKGTQVSFHQCVHCGCRGCASTD

SEQ ID NO: 83 - protein, 487 aa, Saccharomyces cerevisiae
  misc_feature (0)...(0): Polypeptide Accession Number YCR066W
MDHQITTASDFTTTSIPSLYQLDTLLRCHICKDFLKVPVLTPCGHTFCSLCIRTHLNNQPNCPLCLFEFRESLLRSEFLVSEIIQSYTSLRSSLLDALRIPKPTPVPENEEVPGPENSSWIELISESESDSVNAADDDLQIVATSERKLAKRSMTDILPLSSKPSKRNFAMFRSERIKKKSKPNEQMAQCPICQQFYPLKALEKTHLDECLTLQSLGKKPKISTTFPTESNPHNKSSSRFKVRTPEVDKSSCGETSHVDKYLNSMMSAEHQRLPKINFTSMTQSQIKQKLSSLGLSTNGTRQNMIKRYNHYEMLWNSNFCDSLEPVDEAELKRQLLSWDVSHNKTPQNSSNKGGISKLMIMKSNGKSSSYRKLLENFKNDKFNRKGWMVMFRKDFARLIREAKMKIKTGSSDSSGSVGHSNDGDGVEKVQSDQGTEDQQMEKDQDTVINEDRVAGERNLPNEDSTDADLSRELMDLNEYSKDPPGNN

SEQ ID NO: 84 - protein, 1065 aa, Saccharomyces cerevisiae
  misc_feature (0)...(0): Polypeptide Accession Number YCR067C
MSGNSANYDVGYPIYGAKFINEGTLLVAGGGGQFNSSFPNKITALKVNFQKKKHIRRFREITLDSIDDAPTSLDCNNNLILVGCNELFNDSSMENVNHHLRKFVFEQEHLKFVASIDFNRTTDPSVFTKFVYINQRATVAAIASSEVPTVIRIIDPRNLTENYEIETGREVNDLHFAPNGILLSYITSNSLEVASVRDGNFVARKTDFDKNLVLSNIRFLNDNTLLVAASLSNSDGVSLLKLGVSSKGVKILKTASFMFDLNGITSMDVSPNKKFVALSSNDNLVAIVSVEKLKLVQLVPRVHESTITKVTFSPDSRYLASTSMGNTINVLKLSGTSSSILRNIWKFFLNFVLLVVLAGAIQLGYKHNVHGFIYKHAHDIYKSKFKENTTIDQGSSSYFTINDDYRGITESADIISATDVASDIETEFSSFDTSTMRTTTEDEQKFVWISSSADSQFTSADIPTSASSSSSSSSSSFYEESVTNEPIVSSPTSEITKPLASPTEPNIVEKPSLPLNSESIDLLSSSSNSITEYPEPTPDLEEKLSSLIVEQSESEITTDRESVSKLLSTESPSLSHMPSSSSSSLSLSSSLTTSPTTALSTSTATAVTTTQTNPTNDAANTSFLDNSKPASTREIYKTKIITEVITKIEYRNIPASDSNAEAEQYVTTSSSMLLTPTDTMVSSPVSEIDPIASELERMVETPTHSISIASEFDSVASNLIPNEEILSTSASQDSISSHPSTFSDSSITSGFQSIEVSTVTSSVLASESIPSISDSTFSKFHSISEPVSSAIVETATSSFSKTETKTSRVIAFSTEDSERSSALIDNSEYTSVLADNLEPTSVLADNSEPTSVLADSSEPTSVFTDAVQSPKTSVGQSSLSESTNIEGTSMASMIFSSSGASIGALSDIGKGTLSVESASSTVAQPMPGVTTTAPSFVSSPHKISASSIDASGFVQKEIMIEVQSSKDSSEAFGVRHKISENVNTPVSRMLTTEMQASGTVDVTEDVSLSSEVISALNVEITSLPNPVAPPQTIAAPLNNNSNTNIVNDDNAVAGTVNYAGLHDEL

SEQ ID NO: 85 - protein, 128 aa, Saccharomyces cerevisiae
  misc_feature (0)...(0): Polypeptide Accession Number YCR082W
MITPKGTHDAVAKFQKTDLHQDLDYIVLQQRRTQLETLINERESFVKNLCSLFHKIQNTKNYQEFVDVLAENRDLLREIFTVENGFQKQKWISNDDIPQIDWDKFALDINAYIAENDQLLALYEDGLL

SEQ ID NO: 86 - protein, 190 aa, Saccharomyces cerevisiae
  misc_feature (0)...(0): Polypeptide Accession Number YCR086W
MDPLTVYKNSVKQQIDSADLLVANLVNENFVLSEKLDTKATEIKQLQKQIDSLNAQVKELKTQTSQQAENSEVIKDLYEYLCNVRVHKSYEDDSGLWFDISQGTHSGGSSDDYSIMDYKLGFVKGQAQVTEVIYAPVLKQRSTEELYSLQSKLPEYLFETLSFPLSSLNQFYNKIAKSLNKKREKKDETE

SEQ ID NO: 87 - protein, 2108 aa, Saccharomyces cerevisiae
  misc_feature (0)...(0): Polypeptide Accession Number YCR093W
MLSATYRDLNTASNLETSKEKQAAQIVIAQISLLFTTLNNDNFESVEREIRHILDRSSVDIYIKVWERLLTLSSRDILQAGKFLLQENLLHRLLLEFAKDLPKKSTDLIELLKERTFNNQEFQKQTGITLSLFIDLFDKSANKDIIESLDRSSQINDFKTIKMNHTNYLRNFFLQTTPETLESNLRDLLHSLEGESLNDLLALLLSEILSPGSQNLQNDPTRSWLTPPMVLDATNRGNVIARSISSLQANQINWNRVFNLMSTKYFLSAPLMPTTASLSCLFAALHDGPVIDEFFSCDWKVIFKLDLAIQLHKWSVQNGCFDLLNAEGTRKVSETIPNTKQSLLYLLSIASLNLELFLQREELSDGPMLAYFQECFFEDFNYAPEYLILALVKEMKRFVLLIENRTVIDEILITLLIQVHNKSPSSFKDVISTITDDSKIVDAAKIIINSDDAPIANFLKSLLDTGRLDTVINKLPFNEAFKILPCARQIGWEGFDTFLKTKVSPSNVDVVLESLEVQTKMTDTNTPFRSLKTFDLFAFHSLIEVLNKCPLDVLQLQRFESLEFSLLIAFPRLINFGFGHDEAILANGDIAGINNDIEKEMQNYLQKMYSGELAIKDVIELLRRLRDSDLPRDQEVFTCITHAVIAESTFFQDYPLDALATTSVLFGSMILFQLLRGFVLDVAFRIIMRFAKEPPESKMFKFAVQAIYAFRIRLAEYPQYCKDLLRDVPALKSQAQVYQSIVEAATLANAPKERSRPVQEMIPLKFFAVDEVSCQINQEGAPKDVVEKVLFVLNNVTLANLNNKVDELKKSLTPNYFSWFSTYLVTQRAKTEPNYHDLYSKVIVAMGSGLLHQFMVNVTLRQLFVLLSTKDEQAIDKKHLKNLASWLGCITLALNKPIKHKNIAFREMLIEAYKENRLEIVVPFVTKILQRASESKIFKPPNPWTVGILKLLIELNEKANWKLSLTFEVEVLLKSFNLTTKSLKPSNFINTPEVIETLSGALGSITLEQQQTEQQRQIILMQQHQQQMLIYQQRQQQQQQRQQQQQHHISANTIADQQAAFGGEGSISHDNPFNNLLGSTIFVTHPDLKRVFQMALAKSVREILLEVVEKSSGIAVVTTTKIILKDFATEVDESKLKTAAIIMVRHLAQSLARATSIEPLKEGIRSTMQSLAPNLMSLSSSPAEELDTAINENIGIALVLIEKASMDKSTQDLADQLMQAIAIRRYHKERRADQPFITQNTNPYSLSLPEPLGLKNTGVTPQQFRVYEEFGKNIPNLDVIPFAGLPAHAPPMTQNVGSTQPQQQQAQMPTQILTSEQIRAQQQQQQLQKSRLNQPSQSAQPPGVNVPNPQGGIAAVQSDLEQNQRVLVHLMDILVSQIKENATKNNLAELGDQNQIKTIIFQILTFIAKSAQKDQLALKVSQAVVNSLFATSESPLCREVLSLLLEKLCSLSLVARKDVVWWLVYALDSRKFNVPVIRSLLEVNLIDATELDNVLVTAMKNKMENSTEFAMKLIQNTVLSDDPILMRMDFIKTLEHLASSEDENVKKFIKEFEDTKIMPVRKGTKTTRTEKLYLVFTEWVKLLQRVENNDVITTVFIKQLVEKGVISDTDNLLTFVKSSLELSVSSFKESDPTDEVFIAIDALGSLIIKLLILQGFKDDTRRDYINAIFSVIVLVFAKDHSQEGTTFNERPYFRLFSNILYEWATIRTHNFVRISDSSTRQELIEFDSVFYNTFSGYLHALQPFAFPGFSFAWVTLLSHRMLLPIMLRLPNKIGWEKLMLLIIDLFKFLDQYTSKHAVSDAVSVVYKGTLRVILGISNDMPSFLIENHYELMNNLPPTYFQLKNVILSAIPKNMTVPNPYDVDLNMEDIPACKELPEVFFDPVIDLHSLKKPVDNYLRIPSNSLLRTILSAIYKDTYDIKKGVGYDFLSVDSKLIRAIVLHVGIEAGIEYKRTSSNAVFNTKSSYYTLLFNLIQNGSIEMKYQIILSIVEQLRYPNIHTYWFSFVLMNMFKSDEWNDQKLEVQEIILRNFLKRIIVNKPHTWGVSVFFTQLINNNDINLLDLPFVQSVPEIKLILQQLVKYSKKYTTSEQDDQSATINRRQTPLQSNA

SEQ ID NO: 88 - protein, 832 aa, Saccharomyces cerevisiae
  misc_feature (0)...(0): Polypeptide Accession Number YCR106W
MDSITVKKPRLRLVCLQCKKIKRKCDKLRPACSRCQQNSLQCEYEERTDLSANVAANDSDGFNSSHKLNFEQQPVLERTGLRYSLQVPEGVVNATLSIWNAEDMLVIVGLVTFLDYPFAAHSLAQHDQYIRALCASLYGMALVDFSNYANGIPCEDTSRSILGPLSFIEKAIFRRIEHSKQFRVQSAALGLLYNAFSMEEENFSTLLPSLIAEVEDVLMQKKDCEILLRCFYQNIYPFYPFMDISLFESDLTSLLLQDDNNRWKISTEVKNVRKKIETLSLLTIVMAMALMHSKLDANLLSMVKENASESARKLSLLCHKLLCLLDVFRYPNENTFTCLLYFYVSEHLDPESPDCVLSPTNLLTLHHLLNLSMTLGLQYEPSKYKRFKDPEVIRQRRILWLGVQSLLFQISLAEGDAGKSNSEYMEAYLTDFEEYIEASSEYEKSSASESNVQMNDIVWNKYKFHVILSKLMSDCTSVIQHPQLFHILGNIKRSEDFMAENFPTSSIYQPLHEKEPNAIKVGKSTVLDVMDIQKTEIFLTNIVGSMCFLNIFDVLSLHFEKKCVMHWEEYEKNYHFLTLKSFNAYLKLAGLISDYLENKFQGNILESRGYIIDKQICFMLVRIWMFQCRILLRFSYKQESQKKLASSSISTNDNEKEDEMIVILERLIKHIRNQMAHLVDLAKGKLQDSYFGAYQTVPMFRYVVYLIDVGGLVSVTNGFWDKISSDGEIPPKVQQAVRLKWGLDCNNSRRIKQKLISSQSLQSFNQVLLCQMEDAVLSSSFAIKANTAMSQNTAEEFFNISEEEALNQLLENNNFDAFWDLLGENLSDMPSL

SEQ ID NO: 89 - protein, 430 aa, Saccharomyces cerevisiae
  misc_feature (0)...(0): Polypeptide Accession Number YDL001W
MVDSNDDQPERHALLHNDIQTSNNSRPSLVQKKYLPTPQDTRKSRASYTGSAMINPTSKQSRTGSGAQRTSRTAQKLKLLPEEPFQRDSERLTDLKNQEVYSQVNRIKDKPARRDAEKLGKAHRHLLPRSTAYCTASSYNMKELVRWLKDCRKLHHTHPKLFDECLYTPFIYNDWRGDKRFEDEDVIRLDDEGGEIIVSDKHPDLFIFEYGVVVMWGFTEREEKAFLNDIEKFEKEKLAEEDIQVEEFNYYVTKSYQPRIYNDFITLRDGSNYMVKLSISHAIAQSVKISLFEELVDNTIEDTQDIPQEIAYSGKVSMSKEDIMKSIGELFILRININLHGSVLDSPEIMWSEPQLEPIYQATRGYLEINQRVSLLNQRLEVISDLLQMLKEQLGHSHEEYLEFIVILLVGVEVLISVINIVVDMLASQH

SEQ ID NO: 90 - protein, 203 aa, Saccharomyces cerevisiae
  misc_feature (0)...(0): Polypeptide Accession Number YDL002C
MSVEEKKRRLEELKDQNVVLGLAIQRSRLSVKRLKLEYGVLLERLESRIELDPELNCEDPLPTLASFKQELLTKPFRKSKTKRHKVKERDPNMPKRPTNAYLLYCEMNKERIRQNGSLDVTRDLAEGWKNLNEQDRKPYYKLYSEDRERYQMEMEIYNKKISNIDADDDKEENEQKIKNNEEGSSTKVADSKGGEDGSLVSSN

SEQ ID NO: 91 - protein, 281 aa, Saccharomyces cerevisiae
  misc_feature (0)...(0): Polypeptide Accession Number YDL006W
MSNHSEILERPETPYDITYRVGVAENKNSKFRRTMEDVHTYVKNFASRLDWGYFAVFDGHAGIQASKWCGKHLHTIIEQNILADETRDVRDVLNDSFLAIDEEINTKLVGNSGCTAAVCVLRWELPDSVSDDSMDLAQHQRKLYTANVGDSRIVLFRNGNSIRLTYDHKASDTLEMQRVEQAGGLIMKSRVNGMLAVTRSLGDKFFDSLVVGSPFTTSVEITSEDKFLILACDGLWDVIDDQDACELIKDITEPNEAAKVLVRYALENGTTDNVTVMVVFL

SEQ ID NO: 92 - protein, 107 aa, Saccharomyces cerevisiae
  misc_feature (0)...(0): Polypeptide Accession Number YDL011C
MADKLSSTDAMGCWSPTFCFISLISSSTSELPLFVVEVGIAAYSLEDPPAILSILVLNALEVSSFISTVKKFAFCATKNTNNNNSVVMLKILAFLLLEGIIIKLFLY

SEQ ID NO: 93 - protein, 107 aa, Saccharomyces cerevisiae
  misc_feature (0)...(0): Polypeptide Accession Number YDL012C
MSAQDYYGNSASKQSYSRPSAPPPGYETASRGYAPSQSQQNYYPPQQQQQQYQQQPQYYQQQQPQYYQQHPQQPIYVQQQPASSGNEDCLAGCLAGLCLCCTLDMLF

SEQ ID NO: 94 - protein, 619 aa, Saccharomyces cerevisiae
  misc_feature (0)...(0): Polypeptide Accession Number YDL013W
MHSDTNGRTKSNNSPSDNNPNETVILIDSDKEEDASIREANLPVRLYPDRRVGRRRDALNRFVRSDSRSRNSQRTHITASSERPDFQANNDDITIIREVGRFFGDDGPIDPSAHYVDLDQEPGSETLETPRTIQVDNTNGYLNDNGNNNESDDGLTIVEERTTRPRVTLNLPGGERLEVTATTTDIPIRRSFEFQEDLGASRRQLLRRSATRARNLFVDRSDENDEDWTDDTHNLPEAIQRARRESRMRMSRRIAERQRRVQQQRVSSDENISTSIRLQSIRERIQSYTPDIRSAFHRAESLHEFRSILQNVAPITLQECEEELMALFTEFRNQLLQNWAIDRVRNTQEEALRLHREALERQERTAGRVFHRGTLRESITNYLNFNGEDGFLSRLWSGPALSDADEERHTQNIIDMIQEREERERDVVMKNLMNKTRAQQEEFEARAASLPEGYSASFDTTPKMKLDITKNGKEETIIVTDDDLAKTLEDIPVCCLCGAELGVGIPDDFTGISQKDRGVSFEGLVSKYKFHCPYQTLARPSMLDRDLSKRTFIASCGHAFCGRCFARIDNAKKKSKMPKKKLAQLKGSAHPDNYGPKLCPADSCKKLIRSRGRLKEVYF

SEQ ID NO: 95 - protein, 507 aa, Saccharomyces cerevisiae
  misc_feature (0)...(0): Polypeptide Accession Number YDL017W
MTSKTKNIDDIPPEIKEEMIQLYHDLPGIENEYKLIDKIGEGTFSSVYKAKDITGKITKKFASHFWNYGSNYVALKKIYVTSSPQRIYNELNLLYIMTGSSRVAPLCDAKRVRDQVIAVLPYYPHEEFRTFYRDLPIKGIKKYIWELLRALKFVHSKGIIHRDIKPTNFLFNLELGRGVLVDFGLAEAQMDYKSMISSQNDYDNYANTNHDGGYSMRNHEQFCPCIMRNQYSPNSHNQTPPMVTIQNGKVVHLNNVNGVDLTKGYPKNETRRIKRANRAGTRGFRAPEVLMKCGAQSTKIDIWSVGVILLSLLGRRFPMFQSLDDADSLLELCTIFGWKELRKCAALHGLGFEASGLIWDKPNGYSNGLKEFVYDLLNKECTIGTFPEYSVAFETFGFLQQELHDRMSIEPQLPDPKTNMDAVDAYELKKYQEEIWSDHYWCFQVLEQCFEMDPQKRSSAEDLLKTPFFNELNENTYLLDGESTDEDDVVSSSEADLLDKDVLLISE

SEQ ID NO: 96 - protein, 620 aa, Saccharomyces cerevisiae
  misc_feature (0)...(0): Polypeptide Accession Number YDL063C
MGRSKKRSRASSSRLNPLRKAGSNDNNKDTNVVNKKLQPLLQNLSSVVPNDRSIALSSISVLCEDAHMRQLLLKEKLVPIILNKLLNDSNSDIVVESFGLLRNLSLEEGYDVSIYLWRSDIWTSITSNFGRIVESLSALQAAEQQPQLKPAGKSKIESKRLLFDFADNLLSLVVALSNGSDDILNEILTESKINEIFQVISQLLKYGVEKLPINLFNTTLDLIYDLSSESFEFIDHVSNNELLSQFLNGLSPALHPQANELTKVLIEGIHCQFLDMKITYDQCNKMIHSVCHSINNIDPVQLVNDINNPVEIGPATSKDESSKVITKIKDYNAKRNESMIKLQSIEIAIDLITAIIEIVASKYESPESQEVAIPEELINTLTNFLPHVFMILKDTFTSRILIGWNNLIWLFVSLSLTELSGELLTTLWSYVTQLDSQDDLSIKIGRMGCIWALLKLIFPDGAFESENRALINVQMLNNSGFARGIIEEFQNNNDLELQQKCINVLSTYAMIQGQIDANKEIGQFFIQTLTQLNVRPEILIEMTNSLFQIYGDASYDYNEPIFVRGGFLSILKDQVVPNLRQQFKMVDKNKNPELKERCHDCFTTLDSFIHYKMNENSTNQ

SEQ ID NO: 97 - protein, 350 aa, Saccharomyces cerevisiae
  misc_feature (0)...(0): Polypeptide Accession Number YDL065C
MPNIQHEVMNENEYDNFDDLDDLLDEDPTKLDEAEPDDVQAKGSVYNDSENKEKNAESKDSDGVQVANESEEDPELKEMMVDLQNEFANLMKNNGNENNVKTEDFNKLISALEEAAKVPHQQMEQGCSSLKSNSTDKGTVNGSNPGFKNIVSNTLDRLKENGNKVDTSLAEETKESQRSGQNNNIDDILSQLLDQMVASGGKESAENQFDLKDGEMDDAITKILDQMTSKEVLYEPMKEMRSEFGVWFQENGENEEHKEKIGTYKRQFNIVDEIVNIYELKDYDELKHKDRVTELLDELEQLGDSPIRSANSPLKHGNEEEELMKMLEIDGNDPNLGNLDKELTDGCKQQ

SEQ ID NO: 98 - protein, 124 aa, Saccharomyces cerevisiae
  misc_feature (0)...(0): Polypeptide Accession Number YDL071C
MLVRDIAAEVYFAQSVCFSFSAFSLFRSFLATAPALYIKSLPNNKVAETSANVDHFATVSLCTSNEKLALVAPHELLEPLPNIIAHLFESFSAALLLKVCVLSKCSCSCSPSMRKHLRVSPFLF

SEQ ID NO: 99 - protein, 294 aa, Saccharomyces cerevisiae
  misc_feature (0)...(0): Polypeptide Accession Number YDL076C
MSVSEQDPNRAYRETQSQIYKLQETLLNSARTKNKQEEGQESNTHSFPEQYMHYQNGRNSAYDLPNVSSQSVLAFTEKHYPNKLKNLGTLYYNRFKEGSFDEDSTSYSDRHSFPYNLYDNTLPPPFLPAIGIQNINNIATLKITYEDIQASFNNIESPRKRNNEIWGCDIYSDDSDPILVLRHCGFKIGAPSGGSFHKLRRTPVNVTNQDNVTGNLPLLEGTPFDLEVELLFLPTLQKYPSVKRFDITSREWGSEATVIHDGLSYGIYSIVIKQRLDRDKPHEPNGYIKNLKWT

SEQ ID NO: 100 - protein, 528 aa, Saccharomyces cerevisiae
  misc_feature (0)...(0): Polypeptide Accession Number YDL088C
MFGIRSGNNNGGFTNLTSQAPQTTQMFQSQSQLQPQPQPQPQQQQQHLQFNGSSDASSLRFGNSLSNTVNANNYSSNIGNNSINNNNIKNGTNNISQHGQGNNPSWVNNPKKRFTPHTVIRRKTTKQNSSSDINQNDDSSSMNATMRNFSKQNQDSKHNERNKSAANNDINSLLSNFNDIPPSVTLQDWQREDEFGSIPSLTTQFVTDKYTAKKTNRSAYDSKNTPNVFDKDSYVRIANIEQNHLDNNYNTAETNNKVHETSSKSSSLSAIIVFGYPESISNELIEHFSHFGHIMEDFQVLRLGRGINPNTFRIFHNHDTGCDENDSTVNKSITLKGRNNESNNKKYPIFTGESWVKLTYNSPSSALRALQENGTIFRGSLIGCIPYSKNAVEQLAGCKIDNVDDIGEFNVSMYQNSSTSSTSNTPSPPNVIITDGTLLREDDNTPAGHAGNPTNISSPIVANSPNKRLDVIDGKLPFMQNAGPNSNIPNLLRNLESKMRQQEAKYRNNEPAGFTHKLSNWLFGWNDL

SEQ ID NO: 101 - protein, 484 aa, Saccharomyces cerevisiae
  misc_feature (0)...(0): Polypeptide Accession Number YDL089W
MGSNDLINEAYDDSEVVGEERESKSAWMKRWYQLLTSPLDLQLVINEKLEMINWDAYAKSLAKPLGNFLTILFFIIRLLQDNLIKPNYYKLNVKSGAFDLSKSNKLKEFDYLWEISSSFQNNNQFYAFQSWYFVTLRFLNNLFRFTIFILLSLNLYVSCKFMFGYFKTYNLFHLKKEFNSPNLTKHNLKDLSKEYYEDIYKQSLWSMLKHFFRGSRDDGPHVNQNEDEIFFQLRKWIPTNFMINLFVSFSPTAIVFLSFSDVSFTSAIAIVFHQYILDYIITKRFQRSVDDDLILSSAALQEYEDKHIMARINQCSNIDTLSSAMGTRSKTPRIFTTHSLCGEEIREVYNYEKREFEALPKMTESVPGSRETRIKDYGGISQVSDHQSHPIGFHYSPRMSPYYRDKVLDNNLAQSSSNENLEKGGAYLPNQDQNRPSKSLSPLRKTPLSARQKRFEGSEFNVLNKNDINSILRSPKKKKNYHKR

SEQ ID NO: 102 - protein, 431 aa, Saccharomyces cerevisiae
  misc_feature (0)...(0): Polypeptide Accession Number YDL090C
MRQRVGRSIARAKFINTALLGRKRPVMERVVDIAHVDSSKAIQPLMKELETDTTEARYKVLQSVLEIYDDEKNIEPALTKEFHKMYLDVAFEISLPPQMTALDASQPWMLYWIANSLKVMDRDWLSDDTKRKIVDKLFTISPSGGPFGGGPGQLSHLASTYAAINALSLCDNIDGCWDRIDRKGIYQWLISLKEPNGGFKTCLEVGEVDTRGIYCALSIATLLNILTEELTEGVLNYLKNCQNYEGGFGSCPHVDEAHGGYTFCATASLAILRSMDQINVEKLLEWSSARQLQEERGFCGRSNKLVDGCYSFWVGGSAAILEAFGYGQCFNKHALRDYILYCCQEKEQPGLRDKPGAHSDFYHTNYCLLGLAVAESSYSCTPNDSPHNIKCTPDRLIGSSKLTDVNPVYGLPIENVRKIIHYFKSNLSSPS

SEQ ID NO: 103 - protein, 434 aa, Saccharomyces cerevisiae
  misc_feature (0)...(0): Polypeptide Accession Number YDL097C
MSLPGSKLEEARRLVNEKQYNEAEQVYLSLLDKDSSQSSAAAGASVDDKRRNEQETSILELGQLYVTMGAKDKLREFIPHSTEYMMQFAKSKTVKVLKTLIEKFEQVPDSLDDQIFVCEKSIEFAKREKRVFLKHSLSIKLATLHYQKKQYKDSLALINDLLREFKKLDDKPSLVDVHLLESKVYHKLRNLAKSKASLTAARTAANSIYCPTQTVAELDLMSGILHCEDKDYKTAFSYFFESFESYHNLTTHNSYEKACQVLKYMLLSKIMLNLIDDVKNILNAKYTKETYQSRGIDAMKAVAEAYNNRSLLDFNTALKQYEKELMGDELTRSHFNALYDTLLESNLCKIIEPFECVEISHISKIIGLDTQQVEGKLSQMILDKIFYGVLDQGNGWLYVYETPNQDATYDSALELVGQLNKVVDQLFEKASVLY

SEQ ID NO: 104 - protein, 194 aa, Saccharomyces cerevisiae
  misc_feature (0)...(0): Polypeptide Accession Number YDL098C
MSNFGRRTWDREEYAEQARSGYDDRSLKATLTPIELQALKSKYTNYDHLIKGSLKDLNKRKLTANTESLSSFKRGKKFGFYCDICNLTFKDTLQYIDHLNHKVHAIKFENLFDEPLIIDIRDNDDVPQEEFELCYHNLIKDFVEVRSMETQSKRKRLLDTDVEKAKKVATKPSIESESKVSQMMGFSNFATSKK

SEQ ID NO: 105 - protein, 150 aa, Saccharomyces cerevisiae
  misc_feature (0)...(0): Polypeptide Accession Number YDL110C
MCSAGGIRRPIQIEEFKTAISGMSDMELAQIKTEIENSINHLQRSNARLGKYIAKLEGADDRLEADDSDDLENIDSGDLALYKDSVRENEIVLNNYNERVDALEQETVYRKTGHGKSKHEVEAKDNTNKGPDVDMDNSNVDVVTPNSIFI

SEQ ID NO: 106 - protein, 265 aa, Saccharomyces cerevisiae
  misc_feature (0)...(0): Polypeptide Accession Number YDL111C
MSLSVAEKSYLYDSLASTPSIRPDGRLPHQFRPIEIFTDFLPSSNGSSRIIASDGSECIVSIKSKVVDHHVENELLQVDVDIAGQRDDALVVETITSLLNKVLKSGSGVDSSKLQLTKKYSFKIFVDVLVISSHSHPVSLISFAIYSALNSTYLPKLISAFDDLEVEELPTFHDYDMVKLDINPPLVFILAVVGNNMLLDPAANESEVANNGLIISWSNGKITSPIRSVALNDSNVKSFKPHLLKQGLAMVEKYAPDVVRSLENL

SEQ ID NO: 107 - protein, 640 aa, Saccharomyces cerevisiae
  misc_feature (0)...(0): Polypeptide Accession Number YDL113C
MSDLNDVQENAKLNSETRNTGKAEPPHGTTEYVAEAEISKNGVGSPKKSPKKGKVGKGDNNKVETELVHTALLEKDNPFMEEGPTGFTKSALLEIPGMRSHNLKNPNEDYEDDSEGLLPLNQESNAETCRTSLSGSINSMNGETSASEEPSVSNRKKSARIHILEAKRVSEGQGRAYIAYVIQFENSTVQRRYSDFESLRSILIRLFPMTLIPPIPEKQSIKNYGKSITGSSSKYLLPSEGSGSVDLSLSVIHASVNNSDEKLIRHRIRMLTEFLNKLLTNEEITKTSIITDFLDPNNHNWHEFVNSSSTFSSLPKSILQCNPLDPTNTTRIHAMLPIPGSSSQLLLNKESNDKKMDKERSKSFTNIEQDYKQYENLLDNGIYKYNRRTTKTYHDLKSDYNEIGEVFAQFAHEQAQVGELAEQLSYLSNAFSGSSISLEKLVGRLYYNINEPLNESVHMATSARELIKYRKLKYLQNEMIKKSLNSKRAQLEKLEAQNNEYKDVDKIIDNEMSKSHTINLERPNNNTGSGGKSYGGKLFNGFNKLASMVKDSVKYQETDPHTASINLKKEIEQLSESLEVTENDLEVISKVIKNDQLPKFSKEREVDLSEILKHYSRYMRNYARQNLEIWKEVKRHQDFA

SEQ ID NO: 108 - protein, 279 aa, Saccharomyces cerevisiae
  misc_feature (0)...(0): Polypeptide Accession Number YDL127W
MSNYEALLKFNRKAVSKEMVQYLASTTASIIKIKKTNSMIDIALPAPPLTKFINRLIKHSNVQTPTLMATSVYLAKLRSIIPSNVYGIETTRHRIFLGCLILAAKTLNDSSPLNKHWAEYTDGLLILREVNTIERELLEYFDWDVTISTDDLITCLSPFLKPIKEEQLYKSQRDCRTLKNFSAQEKDIVNKTSISHSRSSSNMSIPSLASTSTLSTLESRRSNLSNYSNRIRTLPELHESNNISDKFSPRTYNIDSKHDNKEIGQYRQLSLLILVKRAL

SEQ ID NO: 109 - protein, 437 aa, Saccharomyces cerevisiae
  misc_feature (0)...(0): Polypeptide Accession Number YDL133W
MGDSNSSQEAYSDTTSTNASRIADQNQLNLNVDLEKNQTVRKSGSLEALQNAKIHVPKHSDGSPLDYPKLNTYTFVPTTVPPYVLEAQFDKLRLQDKGTVDGNVTDDKNLPKEFKWGQFASTIGCHSAYTRDQNYNPSHKSYDGYSLSSSTSSKNAALREILGDMCSEWGGEERLEGVLHSEIGANLEFNTTEERKEWLQYIEKVKDFYYGDNKKNPESPESVHNKVYKSDWVNELNKEREKWRRLKQRKLQQWRPPLTSLLLDNQYLILGLRIFTGILSCISLALAIKIFQNSRSNNTISESKIGQQPSTIMAICVNAVAIAYIIYIAHDEFAGKPVGLRNPLSKLKLILLDLLFIIFSSANLALAFNTRFDKEWVCTSIRRSNGSTYGYPKIPRICRKQEALSAFLFVALFMWVITFSISIVRVVEKVSSITNRN

SEQ ID NO: 110 - protein, 202 aa, Saccharomyces cerevisiae
  misc_feature (0)...(0): Polypeptide Accession Number YDL135C
MAEESTDFSQFEEERNNDQYKVSAKKTVDEYKNLDAEDESLAKWKESLGLSSDVLPLEFPGDKRKVVVQKIQLLVNTEPNPITFDLTNEKTIKELASKRYKIKENSIYKLKIVFKVQHEIITGLRYVQYIKKAGIAVDKIDDHLGSYAPNTKTKPFYEVELPESEAPSGFLARGNYSAVSKFIDDDKTNHLTLNWGVEIVKK

SEQ ID NO: 111 - protein, 359 aa, Saccharomyces cerevisiae
  misc_feature (0)...(0): Polypeptide Accession Number YDL144C
MSKMSRILVIGAGGVGVITALSLWLKKESDVSLVVRSDYDRVLKHGYTIESCDYGRLEGWRPHHIYSSVEDAASAADNQGYNYIVVTTKNIIDGPVNSRVSNIIRPVLEKNKELHGPQLTTHILLVQNGIDIEKEIWAEFPREQYRYTVLSGIQLIGSTKIGSGHISQVGQDHLSCGAFDPQDAAAIQAANDFVRMYSNEGQNFVEFDPRVRYSRWKKLLYNAAINTSTALVGLDVPRCLEFGVNKKSTEIEVFHPAMREIIAIAASEGIIIEEEFITMFTEITRKKVFKPSMCVDCEKGQLMELEVILGNPIRIAKRNGVATPTLSILYNLLVLVQAKLKERKGLLKFDEKTATLVDE

SEQ ID NO: 112 - protein, 491 aa, Saccharomyces cerevisiae
  misc_feature (0)...(0): Polypeptide Accession Number YDL146W
MILDPLSPNIENHTQDEIIEFWEKTESIANIPKENLDESHVNSSLVAYLKFATDSYKVFINTDRDLYRMSLILLESSLFEFKKEFCLSKLQSLLNIDLLEMNMKFIIVYILLCEAKKNVYSLEIMLKFQGFTVFYNTLYTQFAYLSKYGKERTVASKHQYNSNNSSTGTSLDSLDRSLTDIDLGIIDEMKQISTVLMDLLFQIMKYCKCVIANLQIVDDFFVYYMMESMRSDTMDDMFNNAEFKLLLALNEQYMMFAKEYDIENKVYKYLINGSVSRCFTELLLLKFNRASDPPLQIMMCKIIYLILTPRGDYSPMNFFYTNDLRVLIDVLIRELQNISEDEEVLRNTLLRVLIPLLKNTQLSKTHYRKDDLNKLLNYLSTLDNICVDSPALHEHQVTVALSRKCLQQIPWLETPSTPSDGGSSVSSNNTSRNSSIVALGTPDNQNILARKGHLYSNRELDVSAESLTKRKAKAPPPPPPPPPSRKCGTPK

SEQ ID NO: 113 - protein, 997 aa, Saccharomyces cerevisiae
  misc_feature (0)...(0): Polypeptide Accession Number YDL149W
MERDEYQLPNSHGKNTFLSRIFGLQSDEVNPSLNSQEMSNFPLPDIERGSSLLHSTNDSREDVDENDLRVPESDQGTSTEEEDEVDEEQVQAYAPQISDGLDGDHQLNSVTSKENVLETEKSNLERLVEGSTDDSVPKVGQLSSEEEEDNEFINNDGFDDDTPLFQKSKIHEFSSKKSNTIEDGKRPLFFRHILQNNRPQRDTQKLFTSSNAIHHDKDKSANNGPRNINGNQKHGTKYFGSATQPRFTGSPLNNTNRFTKLFPLRKPNLLSNISVLNNTPEDRINTLSVKERALWKWANVENLDIFLQDVYNYYLGNGFYCIILEKILNICTLLFVVFVSTYMGHCVDYSKLPTSHRVSDIIIDKCYSNSITGFTKFFLWMFYFFVILKIVQLYFDVQKLSELQNFYKYLLNISDDELQTLPWQNVIQQLMYLKDQNAMTANVVEVKAKNRIDAHDVANRIMRRENYLIALYNSDILNLSLPIPLFRTNVLTKTLEWNINLCVMGFVFNESGFIKQSILKPSQREFTREELQKRFMLAGFLNIILAPFLVTYFVLLYFFRYFNEYKTSPGSIGARQYTPIAEWKFREYNELYHIFKKRISLSTTLANKYVDQFPKEKTNLFLKFVSFICGSFVAILAFLTVFDPENFLNFEITSDRSVIFYITILGAIWSVSRNTITQEYHVFDPEETLKELYEYTHYLPKEWEGRYHKEEIKLEFCKLYNLRIVILLRELTSLMITPFVLWFSLPSSAGRIVDFFRENSEYVDGLGYVCKYAMFNMKNIDGEDTHSMDEDSLTKKIAVNGSHTLNSKRRSKFTAEDHSDKDLANNKMLQSYVYFMDDYSNSENLTGKYQLPAKKGYPNNEGDSFLNNKYSWRKQFQPGQKPELFRIGKHALGPGHNISPAIYSTRNPGKNWDNNNNGDDIKNGTNNATAKNDDNNGNNDHEYVLTESFLDSGAFPNHDVIDHNKMLNSNYNGNGILNKGGVLGLVKEYYKKSDVGR

SEQ ID NO: 114 - protein, 422 aa, Saccharomyces cerevisiae
  misc_feature (0)...(0): Polypeptide Accession Number YDL150W
MSSNKGNGRLPSLKDSSSNGGGSAKPSLKFKPKAVARKSKEEREAAASKVKLEEESKRGNDKKHFNNKNKRVTGAGGQQRRMAKYLNNTHVISSGPLAAGNFVSEKGDLRRGFIKSEGSGSSLVQKGLETIDNGAESSENEAEDDDNEGVASKSKKKFNMGKEFEARNLIEDEDDGESEKSSDVDMDDEEWRSKRIEQLFPVRPVRVRHEDVETVKREIQEALSEKPTREPTPSVKTEPVGTGLQSYLEERERQVNEKLADLGLEKEFQSVDGKEAAAELELLNADHQHILRKLKKMNNKPERFMVFQLPTRLPAFERPAVKEEKEDMETQASDPSKKKKNIKKKDTKDALSTRELAGKVGSIRVHKSGKLSVKIGNVVMDIGKGAETTFLQDVIALSIADDASSAELLGRVDGKIVVTPQI

SEQ ID NO: 115 - protein, 901 aa, Saccharomyces cerevisiae
  misc_feature (0)...(0): Polypeptide Accession Number YDL154W
MSHEWLISASETMRSIGNGEGLRDKGAVVANNDGEFNEGDTNREEDSSTIFSFDFDEEIVMCIDFSGGKLGCSILDYHTKTLKAFDQDYVVNKTTISSHDLIDDADMSSNDISLLLGLLIMEANPTVCLVPARLEDWIFDYIKTKCDEINCRLELQPIKRFKKWDLLQSLQLRGHDNQTILNDILSNSKFTTTVTLGTVGCILANHEQLGEYNDSTASSNMVTGRLVQNAFEDVIHGIRYIDIRDRMVLDENTISALHIFPTAHKLGHDKMMRNGFFSVFELFNQVSSDYARRILKSWLINPLTNKKRIETRYSIIRTLLDKQNAIIFSDLSQSIKRCPDAFGFINQLRSGKSTLGTWSKVASFLEKGIAIFQLVSSLKLGSDEANILHDIKNKVDISALKECLRKVETVIDFDTSRDTKTLTINTGVDNRLDECRNIYNHLEGILLDVARETQIFLLNTMPQEDCKTTKSLEKLVNAVYIPQLGYLVTISVLMEPLLDGIPNLQWEEIFRSSENIYFKNGRVLELDETYGDIYGAISDFEIEILFSLQEQILRRKTQLTAYNILLSELEILLSFAQVSAERNYAEPQLVEDECILEIINGRHALYETFLDNYIPNSTMIDGGLFSELSWCEQNKGRIIVVTGANASGKSVYLTQNGLIVYLAQIGCFVPAERARIGIADKILTRIRTQETVYKTQSSFLLDSQQMAKSLSLATEKSLILIDEYGKGTDILDGPSLFGSIMLNMSKSEKCPRIIACTHFHELFNENVLTENIKGIKHYCTDILISQKYNLLETAHVGEDHESEGITFLFKVKEGISKQSFGIYCAKVCGLSRDIVERAEELSRMINRGDDVVQQCGNLTEKEMREFQKNQEIVKKFLSWDLDLETTTTSENLRLKLKNFLR

SEQ ID NO: 116 - protein, 427 aa, Saccharomyces cerevisiae
  misc_feature (0)...(0): Polypeptide Accession Number YDL155W
MHHNSQSLSSGHIRSPEDENVAPIGNLKHRTGSLSHISSAHPRVALSDVTNIVATNSSNNSISKPKVAPIKERLDSAAIIEEERLDANSVAQRKEADHNDLLTDREQEEPVEDDGESEEDEEEDQEPLLLQHYASDTLVWEHAFRTYYRTTLDPNDDDVYDVVMVAELSNEIFEYMRKLEDLYKPNPYYMDKQPELRWSFRSTLIDWIVQVHEKFQLLPETLYLCINIIDRYLCKEVVPVNKFQLVGAASLFIAAKYEEINCPTIKDFVYMSENCYSRNDLLDAERTILNGLEFELGWPGPMSFLRRISKADDYEHDTRTLAKYLLESTIMDHRLVSAQPSWLAAGAYFLSKIILGQNQWSLAHVYYSNYTQEQILPLATIILENCRYASKRHNAIWRKYSSRRYLHSSQIVAKWIALAEHRVERSN

SEQ ID NO: 117 - protein, 506 aa, Saccharomyces cerevisiae
  misc_feature (0)...(0): Polypeptide Accession Number YDL160C
MGSINNNFNTNNNSNTDLDRDWKTALNIPKKDTRPQTDDVLNTKGNTFEDFYLKRELLMGIFEAGFEKPSPIQEEAIPVAITGRDILARAKNGTGKTAAFVIPTLEKVKPKLNKIQALIMVPTRELALQTSQVVRTLGKHCGISCMVTTGGTNLRDDILRLNETVHILVGTPGRVLDLASRKVADLSDCSLFIMDEADKMLSRDFKTIIEQILSFLPPTHQSLLFSATFPLTVKEFMVKHLHKPYEINLMEELTLKGITQYYAFVEERQKLHCLNTLFSKLQINQAIIFCNSTNRVELLAKKITDLGYSCYYSHARMKQQERNKVFHEFRQGKVRTLVCSDLLTRGIDIQAVNVVINFDFPKTAETYLHRIGRSGRFGHLGLAINLINWNDRFNLYKIEQELGTEIAAIPATIDKSLYVAENDETVPVPFPIEQQSYHQQAIPQQQLPSQQQFAIPPQQHHPQFMVPPSHQQQQAYPPPQMPSQQGYPPQQEHFMAMPPGQSQPQY

SEQ ID NO: 118 - protein, 191 aa, Saccharomyces cerevisiae
  misc_feature (0)...(0): Polypeptide Accession Number YDL165W
MEKFGLKALVPLLKLEDKELSSTYDHSMTLGADLSSMLYSLGIPRDSQDHRVLDTFQSPWAETSRSEVEPRFFTPESFTNIPGVLQSTVTPPCFNSIQNDQQRVALFQDETLFFLFYKHPGTVIQELTYLELRKRNWRYHKTLKAWLTKDPMMEPIVSADGLSERGSYVFFDPQRWEKCQRDFLLFYNAIM

SEQ ID NO: 119 - protein, 623 aa, Saccharomyces cerevisiae
  misc_feature (0)...(0): Polypeptide Accession Number YDL203C
MVNQGQPQPNLYDKHINMFPPARARESSHKLGNANSDRHGLPAQNIVPAPYPVDDSIVELTPAIPFTSPSSSSSLSLPLSALNFTDGNADGGQLGTPVTINSNNGMDIFNSKPTGEIGYANNGTNSTGSRYELPFNFSSTKESLGSPAVQDASISSGNRISESVRDNSAPPPYEESESRILQEKVYRTEEKAPIRPLNNNPVPPQKINQPPTGSAKTDDNGSSGGEDKLSSYSPEALAFYQVYKKTITDSSKFTPEIQMQWCETLLTYAFNEDFISQYNINAEKLKRSLKPEEMLKNQKVILEHSFKVLTKLITLKWPPAMYLMGTLYSHQPYLPIKNKNIVIKNDEKALEYYCKAAKLNNSDACYRAGVCFEYQRGTSSLDPSPTKEQCIKKAFQYYQHGAEVCSNSACMYKLGMSHLYGLNMQKTDVLLAIKWFDKAAQKGDSPQTLYELGKIYEFSVLPPEIQNLLFANGIRKDSQLAIKYYQQCAKDFEYPLAQWKLGNCYEFGDLGLPVVAKKSIYWYSKAAAAQPKGNPMAMLSLSGWYLTGAPNILKPNNKEAFNWALKSSKCSDGKLARTEFALGFYYEKGVGCEVDLDLAKQYYQRAARMGFRKAVDALRSLTN

SEQ ID NO: 120 - protein, 571 aa, Saccharomyces cerevisiae
  misc_feature (0)...(0): Polypeptide Accession Number YDL210W
MSMSSKNENKISVEQRISTDIGQAYQLQGLGSNLRSIRSKTGAGEVNYIDAAKSVNDNQLLAEIGYKQELKRQFSTLQVFGIAFSIMGLLPSIASVMGGGLGGGPATLVWGWFVAAFFILLVGITMAEHASSIPTAGGLYYWTYYYAPEGYKEIISFIIGCSNSLALAAGVCSIDYGLAEEIAAAVTLTKDGNFEVTSGKLYGIFAGAVVVMCICTCVASGAIARLQTLSIFANLFIIVLLFIALPIGTKHRMGGFNDGDFIFGKYENLSDWNNGWQFCLAGFMPAVWTIGSFDSCVHQSEEAKDAKKSVPIGIISSIAVCWILGWLIIICLMACINPDIDSVLDSKYGFALAQIIYDSLGKKWAIAFMSLIAFCQFLMGASITTAVSRQVWAFSRDNGLPLSKYIKRVDSKYSVPFFAILAACVGSLILGLLCLIDDAATDALFSLAVAGNNLAWSTPTVFRLTSGRDLFRPGPFYLGKIWSPIVAWTGVAFQLFIIILVMFPSQQHGITKSTMNYACVIGPGIWILAGIYYKVYKKKYYHGPATNLSDDDYTEAVGADVIDTIMSKQEP

SEQ ID NO: 121 - protein, 210 aa, Saccharomyces cerevisiae
  misc_feature (0)...(0): Polypeptide Accession Number YDL212W
MFSYSDFCSIGTAMILSATTFLMGVFFSNMPYDYHLLFNPNSTQEHFDLALRHYQILHETPLPVIVTLCVVAGIGLVGGTIKVFKPNPELQMFEYCSLGLYVLAICVFLTNVKTGIDCSVSHNWGEVTENQGLAVIASSNIILLVMFAGVIILQIGLWYSNWDLQKRLKEFYAQEEREAANAGKKTEKVDNAKKNDNKSKGAQKRKNAKK

SEQ ID NO: 122 - protein, 1092 aa, Saccharomyces cerevisiae
  misc_feature (0)...(0): Polypeptide Accession Number YDL215C
MLFDNKNRGALNSLNTPDIASLSISSMSDYHVFDFPGKDLQREEVIDLLDQQGFIPDDLIEQEVDWFYNSLGIDDLFFSRESPQLISNIIHSLYASKLDFFAKSKFNGIQPRLFSIKNKIITNDNHAIFMESNTGVSISDSQQKNFKFASDAVGNDTLEHGKDTIKKNRIEMDDSCPPYELDSEIDDLFLDNKSQKNCRLVSFWAPESELKLTFVYESVYPNDDPAGVDISSQDLLKGDIESISDKTMYKVSSNENKKLYGLLLKLVKEREGPVIKTTRSVENKDEIRLLVAYKRFTTKRYYSALNSLFHYYKLKPSKFYLESFNVKDDDIIIFSVYLNENQQLEDVLLHDVEAALKQVEREASLLYAIPNNSFHEVYQRRQFSPKEAIYAHIGAIFINHFVNRLGSDYQNLLSQITIKRNDTTLLEIVENLKRKLRNETLTQQTIINIMSKHYTIISKLYKNFAQIHYYHNSTKDMEKTLSFQRLEKVEPFKNDQEFEAYLNKFIPNDSPDLLILKTLNIFNKSILKTNFFITRKVAISFRLDPSLVMTKFEYPETPYGIFFVVGNTFKGFHIRFRDIARGGIRIVCSRNQDIYDLNSKNVIDENYQLASTQQRKNKDIPEGGSKGVILLNPGLVEHDQTFVAFSQYVDAMIDILINDPLKENYVNLLPKEEILFFGPDEGTAGFVDWATNHARVRNCPWWKSFLTGKSPSLGGIPHDEYGMTSLGVRAYVNKIYETLNLTNSTVYKFQTGGPDGDLGSNEILLSSPNECYLAILDGSGVLCDPKGLDKDELCRLAHERKMISDFDTSKLSNNGFFVSVDAMDIMLPNGTIVANGTTFRNTFHTQIFKFVDHVDIFVPCGGRPNSITLNNLHYFVDEKTGKCKIPYIVEGANLFITQPAKNALEEHGCILFKDASANKGGVTSSSMEVLASLALNDNDFVHKFIGDVSGERSALYKSYVVEVQSRIQKNAELEFGQLWNLNQLNGTHISEISNQLSFTINKLNDDLVASQELWLNDLKLRNYLLLDKIIPKILIDVAGPQSVLENIPESYLKVLLSSYLSSTFVYQNGIDVNIGKFLEFIGGLKREAEASA

SEQ ID NO: 123 - protein, 455 aa, Saccharomyces cerevisiae
  misc_feature (0)...(0): Polypeptide Accession Number YDL216C
MNNNDRKSIKTAGGSMSLSNKTVKELRQLLKERYTVEDELTESIALSSMRFKPSQEPEFHALSQSSLLKTKLKQQSSTDIPSYTHVLISKLSCEKITHYAVRGGNIEIMGILMGFTLKDNIVVMDCFNLPVVGTETRVNAQLESYEYMVQYIDEMYNHNDGGDGRDYKGAKLNVVGWFHSHPGYDCWLSNIDIQTQDLNQRFQDPYVAIVVDPLKSLEDKILRMGAFRTIESKSDDNSATSYYELETIIFDSELNRALFETKLNLHCVIEDDESEQISLNRLIDSMKQYSYLMDSKNVRTRIKLATTSERVSNENKKNIDYQNRSTRSQFCLNTQRGDSTETSSFGSMFSGDNTSDVDMEDRNLTEFDSTDTSLCINGEPSIHVNRVERSSRSTDNFHNSKKRMNSNQERCHDEGNDMLQRNVLETDYARAKNRILASKIKQYERLRFYKDTFTL

SEQ ID NO: 124 - protein, 312 aa, Saccharomyces cerevisiae
  misc_feature (0)...(0): Polypeptide Accession Number YDL236W
MTAQQGVPIKITNKEIAQEFLDKYDTFLFDCDGVLWLGSQALPYTLEILNLLKQLGKQLIFVTNNSTKSRLAYTKKFASFGIDVKEEQIFTSGYASAVYIRDFLKLQPGKDKVWVFGESGIGEELKLMGYESLGGADSRLDTPFDAAKSPFLVNGLDKDVSCVIAGLDTKVNYHRLAVTLQYLQKDSVHFVGTNVDSTFPQKGYTFPGAGSMIESLAFSSNRRPSYCGKPNQNMLNSIISAFNLDRSKCCMVGDRLNTDMKFGVEGGLGGTLLVLSGIETEERALKISHDYPRPKFYIDKLGDIYTLTNNEL

SEQ ID NO: 125 - protein, 790 aa, Saccharomyces cerevisiae
  misc_feature (0)...(0): Polypeptide Accession Number YDL239C
MNHWLAFLNKPESLKEQNSDCDQQGEMRHVTDGTLTKSPESKPFRERRSQTWIDSEVPTSTEKSNVQESISSDIISKLSNRRSRRNRSESWAGSEASSPSGNISTLENATEKNTLKSPNKFLQRGGLPTVGIGSQALSPAGKPSTLGNVSPGKFTTYKVHNSIEVNRFSSTPTKLLTNPHKVAAISNDEHYVVSNESLEENIEVAHLENVFRSSKTPDEEQSEYMKLGEIRLSSSSYGGSISKENSLPKVLDELQSQNEEIKALRQKLEEKDDRIQELEELNSMNDAKLQRIEDLQKEFHNERKAASKRLNIVQDRFRKEIKKIREEKITDFQNKNASKKEKNEVTSAKTKCKAFSQRNILVSELYRKQKQILNLQQENDKFLKDINESNNSIVKLRSEVEILKSNLQLSQDENKKLHDNGSFYEKRLNDVYSYMQNLSLFEKDLGKFILEEMKCGHSPSMFQNGFAKLYPDFQDIKNLENMEQYKQLKGKIELLEKNDRIRLEKIISVFKLINERLHFMQQQHSHKIKYLQKEALTKEQQFRLEKRRWHDILNLKEENFQKLKSELKGKLILSEKIQKNAEDKLNDYMNEHQEIVEKLQNQALIASRWSTQIQESENTHKKITDELAGKQSEILKLEETILSLKEDVFQEKLNLKKLYGDPSTELNFETVGKSFPHITKEKYDSLGLDILTDLTYVQSQNLIKNLLIVLDIPLKTFLKIVPTIVIQLRCELTLLTKFANDLNLKVFGKQLDFKSRRKVAMNEFLNNHDIAEVKHPLEYDLQALFKYFFS

SEQ ID NO: 126 - protein, 357 aa, Saccharomyces cerevisiae
  misc_feature (0)...(0): Polypeptide Accession Number YDL246C
MSQNSNPAVVLEKVGDIAIEQRPIPTIKDPHYVKLAIKATGICGSDIHYYRSGGIGKYILKAPMVLGHESSGQVVEVGDAVTRVKVGDRVAIEPGVPSRYSDETKEGSYNLCPHMAFAATPPIDGTLVKYYLSPEDFLVKLPEGVSYEEGACVEPLSVGVHSNKLAGVRFGTKVVVFGAGPVGLLTGAVARAFGATDVIFVDVFDNKLQRAKDFGATNTFNSSQFSTDKAQDLADGVQKLLGGNHADVVFECSGADVCIDAAVKTTKVGGTMVQVGMGKNYTNFPIAEVSGKEMKLIGCFRYSFGDYRDAVNLVATGKVNVKPLITHKFKFEDAAKAYDYNIAHGGEVVKTIIFGPE

SEQ ID NO: 127 - protein, 751 aa, Saccharomyces cerevisiae
  misc_feature (0)...(0): Polypeptide Accession Number YDR001C
MSQVNTSQGPVAQGRQRRLSSLSEFNDPFSNAEVYYGPPTDPRKQKQAKPAKINRTRTMSVFDNVSPFKKTGFGKLQQTRRGSEDDTYSSSQGNRRFFIEDVDKTLNELLAAEDTDKNYQITIEDTGPKVLKVGTANSYGYKHINIRGTYMLSNLLQELTIAKSFGRHQIFLDEARINENPVNRLSRLINTQFWNSLTRRVDLNNVGEIAKDTKIDTPGAKNPRIYVPYDCPEQYEFYVQASQMHPSLKLEVEYLPKKITAEYVKSVNDTPGLLALAMEEHFNPSTGEKTLIGYPYAVPGGRFNELYGWDSYMMALGLLEANKTDVARGMVEHFIFEINHYGKILNANRSYYLCRSQPPFLTEMALVVFKKLGGRSNPDAVDLLKRAFQASIKEYKTVWTASPRLDPETGLSRYHPNGLGIPPETESDHFDTVLLPYASKHGVTLDEFKQLYNDGKIKEPKLDEFFLHDRGVRESGHDTTYRFEGVCAYLATIDLNSLLYKYEIDIADFIKEFCDDKYEDPLDHSITTSAMWKEMAKIRQEKITKYMWDDESGFFFDYNTKIKHRTSYESATTFWALWAGLATKEQAQKMVEKALPKLEMLGGLAACTERSRGPISISRPIRQWDYPFGWAPHQILAWEGLRSYGYLTVTNRLAYRWLFMMTKAFVDYNGIVVEKYDVTRGTDPHRVEAEYGNQGADFKGAATEGFGWVNASYILGLKYMNSHARRALGACIPPISFFSSLRPQERNLYGL

SEQ ID NO: 128 - protein, 201 aa, Saccharomyces cerevisiae
  misc_feature (0)...(0): Polypeptide Accession Number YDR002W
MSSEDKKPVVDKKEEAAPKPPSSAVFSMFGGKKAEKPETKKDEEDTKEETKKEGDDAPESPDIHFEPVVHLEKVDVKTMEEDEEVLYKVRAKLFRFDADAKEWKERGTGDCKFLKNKKTNKVRILMRRDKTLKICANHIIAPEYTLKPNVGSDRSWVYACTADIAEGEAEAFTFAIRFGSKENADKFKEEFEKAQEINKKA

SEQ ID NO: 129 - protein, 208 aa, Saccharomyces cerevisiae
  misc_feature (0)...(0): Polypeptide Accession Number YDR013W
MYGDLGNKLVLEAKRTKQLYARSNQDVNLPMYHEDIIRNILKEVSNLRKNTEYLKEQQQLGMLDDKVAKCQYFVTLLCMERNKRCLLAYQRLRTDILDSMAWNNNGLDLMSSITFSQQDTNNLSHQEQEYLKEYCDLITDLKSGDLVDIDLSGSLVPPSDVFIDVRVLKDAGEIQTEYGVFNLIKDSQFFVRQSDVERLIQQGYLQKI

SEQ ID NO: 130 - protein, 94 aa, Saccharomyces cerevisiae
  misc_feature (0)...(0): Polypeptide Accession Number YDR016C
MMASTSNDEEKLISTTDKYFIEQRNIVLQEINETMNSILNGLNGLNISLESSIAVGREFQSVSDLWKTLYDGLESLSDEAPIDEQPTLSQSKTK

SEQ ID NO: 131 - protein, 1050 aa, Saccharomyces cerevisiae
  misc_feature (0)...(0): Polypeptide Accession Number YDR017C
MDTSHEIHDKIPDTLREQQQHLRQKESEGCITTLKDLNVPETKKLSSVLHGRKASTYLRIFRDDECLADNNNGVDSNNGGSVTCADKITRSEATPKSVPEGLQVSEKKNNPDTLSSSLSSFILSNHEEPAIKPNKHVAHRNNITETGQGSGEDIAKQQSHQPQVLHHQTSLKPIQNVDEGCISPKSTYQESLHGISEDLTLKPVSSATYYPHKSKADSGYEEKDKMENDIDTIQPATINCASGIATLPSSYNRHTFKVKTYSTLSQSLRQENVNNRSNEKKPQQFVPHSESIKEKPNTFEQDKEGEQADEEEDEGDNEHREYPLAVELKPFTNRVGGHTAIFRFSKRAVCKALVNRENRWYENIELCHKELLQFMPRYIGVLNVRQHFQSKDDFLSDLDQENNGKNDTSNENKDIEVNHNNNDDIALNTEPTGTPLTHIHSFPLEHSSRQVLEKEHPEIESVHPHVKRSLSSSNQPSLLPEVVLNDNRHIIPESLWYKYSDSPNSAPNDSYFSSSSSHNSCSFGERGNTNKLKRRDSGSTMINTELKNLVIREVFAPKCFRRKRNSNTTTMGNHNARLGSSPSFLTQKSRASSHDASNTSMKTLGDSSSQASLQMDDSKVNPNLQDPFLKKSLHEKISNALDGSHSVMDLKQFHKNEQIKHKNSFCNSLSPILTATNSRDDGEFATSPNYISNAQDGVFDMDEDTGNETINMDNHGCHLDSGKNMIIKSLAYNVSNDYSHHDIESITFEETSHTIVSKFILLEDLTRNMNKPCALDLKMGTRQYGVDAKRAKQLSQRAKCLKTTSRRLGVRICGLKVWNKDYYITRDKYFGRRVKVGWQFARVLARFLYDGKTIESLIRQIPRLIKQLDTLYSEIFNLKGYRLYGASLLLMYDGDANKSNSKRKKAANVKVNLIDFARCVTKEDAMECMDKFRIPPKSPNIEDKGFLRGVKSLRFYLLLIWNYLTSDMPLIFDEVEMNDMISEEADSNSFTSATGSKINFNSKWDWLDEFDKEDEEMYNDPNSKLRQKWRKYELIFDAEPRYNDDAQVSD

SEQ ID NO: 132 - protein, 232 aa, Saccharomyces cerevisiae
  misc_feature (0)...(0): Polypeptide Accession Number YDR020C
MDRKAVEEKRIVISIGGGHATGVGAIALDLQNTFKSLYNSINIRVINLDNMIEGNIKSYNNNDYDFDNILNLVYEKHAVTSQNDMIQHDYEDPIDLIIVCGCYALYDKRINEISQLKVFLDSDADKRLISLIKKKNVGSNEQLAQLITEYMDHLRPEMQQYIEPTRTFADLIIPSTNENLGRAVLVDGIVKAIEDTKSQIEGNNTNNKIRPRLWDFEAETMDLEKDRYYDLS

SEQ ID NO: 133 - protein, 570 aa, Saccharomyces cerevisiae
  misc_feature (0)...(0): Polypeptide Accession Number YDR026C
MDSVSNLKSTNFQNNNDPKESVEEAVLRYVGVDLKNHIKKTKKKLKKQKKRKHGSKMSHEDEDTDMDWYLKTSGSKDLRKVDDIEPNSVAVAAVAAAYNSSMREKDKRSCHKKSSNSRSERKKHRKRKSSKERKAKIKMVLDPQLTTLDDGITTTAFLPDDLIAETAFDKYVDTEKAYLAKHPSKSLEVNEDDKENNFNNNSSTLVRIYTDLEGIPNDGSYIKRTPKIPEKDVKSDDLILAPEENNGDTALLRSDIVKASVIDGAITKSIGKKFTPSEENALDQFIEEYMKIRGLDRRQMCERIWSTDGVIRDGFWANISKVLPYRTRSSIYKHIRRKYHIFEQRGKWTPEEDQELARLCLEKEGHWTEVGKLLGRMPEDCRDRWRNYMKCGSKRGSKRWSKEEEELLTTVVNEMIEEAHQYQRMKALEAANKNDRYNQMYSRGPKGKRISDNPTFKDMINWTVVSERMSGTRSRIQCRYKWNKLVTDEAARSMLSIPVSERKWLLERLKQLPKTSYSNIDWNSIATYKPGYPRTGLELRLCYEQMREKIHDFKGRSTAEIIDSLLEQIN

SEQ ID NO: 134 - protein, 198 aa, Saccharomyces cerevisiae
  misc_feature (0)...(0): Polypeptide Accession Number YDR032C
MPRVAIIIYTLYGHVAATAEAEKKGIEAAGGSADIYQVEETLSPEVVKALGGAPKPDYPIATQDTLTEYDAFLFGIPTRFGNFPAQWKAFWDRTGGLWAKGALHGKVAGCFVSTGTGGGNEATIMNSLSTLAHHGIIFVPLGYKNVFAELTNMDEVHGGSPWGAGTIAGSDGSRSPSALELQVHEIQGKTFYETVAKF

SEQ ID NO: 135 - protein, 328 aa, Saccharomyces cerevisiae
  misc_feature (0)...(0): Polypeptide Accession Number YDR044W
MPAPQDPRNLPIRQQMEALIRRKQAEITQGLESIDTVKFHADTWTRGNDGGGGTSMVIQDGTTFEKGGVNVSVVYGQLSPAAVSAMKADHKNLRLPEDPKTGLPVTDGVKFFACGLSMVIHPVNPHAPTTHLNYRYFETWNQDGTPQTWWFGGGADLTPSYLYEEDGQLFHQLHKDALDKHDTALYPRFKKWCDEYFYITHRKETRGIGGIFFDDYDERDPQEILKMVEDCFDAFLPSYLTIVKRRKDMPYTKEEQQWQAIRRGRYVEFNLIYDRGTQFGLRTPGSRVESILMSLPEHASWLYNHHPAPGSREAKLLEVTTKPREWVK

SEQ ID NO: 136 - protein, 334 aa, Saccharomyces cerevisiae
  misc_feature (0)...(0): Polypeptide Accession Number YDR051C
MCEENVHVSEDVAGSHGSFTNARPRLIVLIRHGESESNKNKEVNGYIPNHLISLTKTGQIQARQAGIDLLRVLNVDDHNLVEDLAKKYIKDESSRRTLPLKDYTRLSREKDTNIVFYTSPYRRARETLKGILDVIDEYNELNSGVRICEDMRYDPHGKQKHAFWPRGLNNTGGVYENNEDNICEGKPGKCYLQYRVKDEPRIREQDFGNFQKINSMQDVMKKRSTYGHFFFRFPHGESAADVYDRVASFQETLFRHFHDRQERRPRDVVVLVTHGIYSRVFLMKWFRWTYEEFESFTNVPNGSVMVMELDESINRYVLRTVLPKWTDCEGDLTT

SEQ ID NO: 137 - protein, 295 aa, Saccharomyces cerevisiae
  misc_feature (0)...(0): Polypeptide Accession Number YDR054C
MSSRKSTASSLLLRQYRELTDPKKAIPSFHIELEDDSNIFTWNIGVMVLNEDSIYHGGFFKAQMRFPEDFPFSPPQFRFTPAIYHPNVYRDGRLCISILHQSGDPMTDEPDAETWSPVQTVESVLISIVSLLEDPNINSPANVDAAVDYRKNPEQYKQRVKMEVERSKQDIPKGFIMPTSESAYISQSKLDEPESNKDMADNFWYDSDLDDDENGSVILQDDDYDDGNNHIPFEDDDVYNYNDNDDDDERIEFEDDDDDDDDSIDNDSVMDRKQPHKAEDESEDVEDVERVSKKI

SEQ ID NO: 138 - protein, 539 aa, Saccharomyces cerevisiae
  misc_feature (0)...(0): Polypeptide Accession Number YDR061W
MSTNKFVVRITNALFKSSLASNSPPVYPKRIRHFEILPNEKWVIWGPGKGKFLDVLNNKYICEPPLSLRFGFLKESSNILPRIEQVAFKGVMPTAHLSARYEYFKDDYDQTCKQFIFDKASGSNAVSYKVETNNRQINMELYNALVENLNLSSLQDRWVMGLSNGQMRRARLARSILKEPDLLLIDDPFLGLDPAAIATISQFLAKYDSIEVSGGCPIVIGLRYQDTIPAWCTHICCVDEKNGILFEGPIEKLQSKMDETRSRALKELEQLKKASNSKEDISINDLICIHPMYGKKEHEIIKMPHLIELDGLSVSYKGEAVLENLHWKVQPGSKWHIRGDNGSGKSTLLSLLTAEHPQSWNSRVIDNGVPRRTGKTNYFDLNSKIGMSSPELHAIFLKNAGGRLNIRESVATGYHEASSNNYLPIWKRLDKNSQEIVNMYLKYFGLDKDADSVLFEQLSVSDQKLVLFVRSLIKMPQILILDEAFSGMEVEPMMRCHEFLEEWPGTVLVVAHVAEETPKCAHYLRLISPGEYEIGDMEN

SEQ ID NO: 139 - protein, 93 aa, Saccharomyces cerevisiae
  misc_feature (0)...(0): Polypeptide Accession Number YDR070C
MLRTTFLRTPRQLMRKSPRASFSIVTRAAFPHLKNNQDEAEKKEQGLFDSNKKRLDTLEHGKNPDYKQPGMEDLKKKGDDARIEQNRPDDGVY

SEQ ID NO: 140 - protein, 191 aa, Saccharomyces cerevisiae
  misc_feature (0)...(0): Polypeptide Accession Number YDR071C
MASSSSTLPLHMYIRPLIIEDLKQILNLESQGFPPNERASEEIISFRLINCPELCSGLFIREIEGKEVKKETLIGHIMGTKIPHEYITIESMGKLQVESSNHIGIHSVVIKPEYQKKNLATLLLTDYIQKLSNQEIGNKIVLIAHEPLIPFYERVGFKIIAENTNVAKDKNFAEQKWIDMERELIKEEYDN

SEQ ID NO: 141 - protein, 169 aa, Saccharomyces cerevisiae
  misc_feature (0)...(0): Polypeptide Accession Number YDR073W
MSSEIAYSNTNTNTENENRNTGAGVDVNTNANANANATANATANATANATAELNLPTVDEQRQYKVQLLLHINSILLARVIQMNNSLQNNLQNNINNSNNNNIIRIQQLISQFLKRVHANLQCISQINQGVPSAKPLILTPPQLANQQQPPQDILSKLYLLLARVFEIW

SEQ ID NO: 142 - protein, 896 aa, Saccharomyces cerevisiae
  misc_feature (0)...(0): Polypeptide Accession Number YDR074W
MTTTAQDNSPKKRQRIINCVTQLPYKIQLGESNDDWKISATTGNSALFSSLEYLQFDSTEYEQHVVGWTGEITRTERNLFTREAKEKPQDLDDDPLYLTKEQINGLTTTLQDHMKSDKEAKTDTTQTAPVTNNVHPVWLLRKNQSRWRNYAEKVIWPTFHYILNPSNEGEQEKNWWYDYVKFNEAYAQKIGEVYRKGDIIWIHDYYLLLLPQLLRMKFNDESIIIGYFHHAPWPSNEYFRCLPRRKQILDGLVGANRICFQNESFSRHFVSSCKRLLDATAKKSKNSSNSDQYQVSVYGGDVLVDSLPIGVNTTQILKDAFTKDIDSKVLSIKQAYQNKKIIIGRDRLDSVRGVVQKLRAFETFLAMYPEWRDQVVLIQVSSPTANRNSPQTIRLEQQVNELVNSINSEYGNLNFSPVQHYYMRIPKDVYLSLLRVADLCLITSVRDGMNTTALEYVTVKSHMSNFLCYGNPLILSEFSGSSNVLKDAIVVNPWDSVAVAKSINMALKLDKEEKSNLESKLWKEVPTIQDWTNKFLSSLKEQASSNDDMERKMTPALNRPVLLENYKQAKRRLFLFDYDGTLTPIVKDPAAAIPSARLYTILQKLCADPHNQIWIISGRDQKFLNKWLGGKLPQLGLSAEHGCFMKDVSCQDWVNLTEKVDMSWQVRVNEVMEEFTTRTPGSFIERKKVALTWHYRRTVPELGEFHAKELKEKLLSFTDDFDLEVMDGKANIEVRPRFVNKGEIVKRLVWHQHGKPQDMLKGISEKLPKDEMPDFVLCLGDDFTDEDMFRQLNTIETCWKEKYPDQKNQWGNYGFYPVTVGSASKKTVAKAHLTDPQQVLETLGLLVGDVSLFQSAGTVDLDSRGHVKNSESSLKSKLASKAYVMKRSASYTGAKV

SEQ ID NO: 143 - protein, 406 aa, Saccharomyces cerevisiae
  misc_feature (0)...(0): Polypeptide Accession Number YDR076W
MSLGIPLSQLIVESPKPLSSGITGLDEILNLGFQARSIYEIFGPPGIGKTNFGIQLVCNSLEGIQQSEINDDKILWIETFQEMPINILRERFQKFKIVEENVKRVRITKFGQLLYFFQNLFKLSQSVRYKLVIIDGFSQLVCDHLCTLSKRGGGMIDKTIHELKCRHLILIFTVMTKYTHSTGSTIIVLNDCMNTAFQSNEFESLEEYYEILDDGSNFFVNSNNERRKNNVHILKSALVANIAMGSKDSTWEVFLRDRIGLFRDWNEQVDETVFVKSKRVKASSSQSNEGCTTIKEMRINKRNFENLRIAIVFNLHGEDRKREGRNLKRSRSSDDRNYIVKFDFDKATGQLRDIIDLKPDTANIASFPTLSTSSSSCSQVFNNIDSNDNPLPNAEGKEEIIYDSEG

SEQ ID NO: 144 - protein, 338 aa, Saccharomyces cerevisiae
  misc_feature (0)...(0): Polypeptide Accession Number YDR077W
MKLSTVLLSAGLASTTLAQFSNSTSASSTDVTSSSSISTSSGSVTITSSEAPESDNGTSTAAPTETSTEAPTTAIPTNGTSTEAPTTAIPTNGTSTEAPTDTTTEAPTTALPTNGTSTEAPTDTTTEAPTTGLPTNGTTSAFPPTTSLPPSNTTTTPPYNPSTDYTTDYTVVTEYTTYCPEPTTFTTNGKTYTVTEPTTLTITDCPCTIEKPTTTSTTEYTVVTEYTTYCPEPTTFTTNGKTYTVTEPTTLTITDCPCTIEKSEAPESSVPVTESKGTTTKETGVTTKQTTANPSLTVSTVVPVSSSASSHSVVINSNGANVVVPGALGLAGVAMLFL

SEQ ID NO: 145 - protein, 223 aa, Saccharomyces cerevisiae
  misc_feature (0)...(0): Polypeptide Accession Number YDR078C
MSKDVIEYSKLFAKLVNTNDDTKLDDTIASFLYYMFPRELFIRAISLLESSDMFIYILDRVHNKEGNEHTSLIDVLVDEFYKGSSNSLLEYRLIVKDTNDGAPPILVDIAHWFCSCEEFCKYFHEALEKTDEKEELHDVLINEVDDHLQFSDDRFAQLDPHSLSKQWYFKFDKVCCSHLLAFSILLRSSINVLKFFTVNSNKVFVIAIDNIDEWLNLHINIVE

SEQ ID NO: 146 - protein, 199 aa, Saccharomyces cerevisiae
  misc_feature (0)...(0): Polypeptide Accession Number YDR084C
MDQARNFYNTILKSSHPLLLSFHLAGKAVPIVFYIIGSMFLNFTPQFITVVLLLSFDFYLTKNITGRKLVQLRWWYDSTDVNKDSNFTFESYKQYAPGPPINAIDSKLFWWSMYVTPVIWGVFAVLCLLRLKIFYLILVIVAMCLTAWNTYGFRCCDRWEPNSGQSDGQDTNNWFALPSVPGFENLSRLANIQSFFQRQ

SEQ ID NO: 147 - protein, 382 aa, Saccharomyces cerevisiae
  misc_feature (0)...(0): Polypeptide Accession Number YDR088C
MNNNSRNNENRSTINRNKRQLQQAKEKNENIHIPRYIRNQPWYYKDTPKEQEGKKPGNDDTSTAEGGEKSDYLVHHRQKAKGGALDIDNNSEPKIGMGIKDEFKLIRPQKMSVRDSHSLSFCRNCGEAGHKEKDCMEKPRKMQKLVPDLNSQKNNGTVLVRATDDDWDSRKDRWYGYSGKEYNELISKWERDKRNKIKGKDKSQTDETLWDTDEEIELMKLELYKDSVGSLKKDDADNSQLYRTSTRLREDKAAYLNDINSTESNYDPKSRLYKTETLGAVDEKSKMFRRHLTGEGLKLNELNQFARSHAKEMGIRDEIEDKEKVQHVLVANPTKYEYLKKKREQEETKQPKIVSIGDLEARKVDGTKQSEEQRNHLKDLYG

SEQ ID NO: 148 - protein, 285 aa, Saccharomyces cerevisiae
  misc_feature (0)...(0): Polypeptide Accession Number YDR098C
MCSFQVPSAFSFNYTSYCYKRHQARYYTAAKLFQEMPVIEINDQEQFTYLTTTAAGDKLIVLYFHTSWAEPCKALKQVFEAISNEPSNSNVSFLSIDADENSEISELFEISAVPYFIIIHKGTILKELSGADPKEYVSLLEDCKNSVNSGSSQTHTMENANVNEGSHNDEDDDDEEEEEETEEQINARLTKLVNAAPVMLFMKGSPSEPKCGFSRQLVGILREHQVRFGFFDILRDESVRQNLKKFSEWPTFPQLYINGEFQGGLDIIKESLEEDPDFLQHALQS

SEQ ID NO: 149 - protein, 273 aa, Saccharomyces cerevisiae
  misc_feature (0)...(0): Polypeptide Accession Number YDR099W
MSQTREDSVYLAKLAEQAERYEEMVENMKAVASSGQELSVEERNLLSVAYKNVIGARRASWRIVSSIEQKEESKEKSEHQVELIRSYRSKIETELTKISDDILSVLDSHLIPSATTGESKVFYYKMKGDYHRYLAEFSSGDAREKATNSSLEAYKTASEIATTELPPTHPIRLGLALNFSVFYYEIQNSPDKACHLAKQAFDDAIAELDTLSEESYKDSTLIMQLLRDNLTLWTSDISESGQEDQQQQQQQQQQQQQQQQQAPAEQTQGEPTK

SEQ ID NO: 150 - protein, 284 aa, Saccharomyces cerevisiae
  misc_feature (0)...(0): Polypeptide Accession Number YDR106W
MSNTIVIVYLGANRIEIGRSADACPQEIIAWKTGSINEKNREELKKIFEHYFQICNILGNREVQVLILEDIFISVVEKRIICSILFKEFDCAHVSFVPRAIVHCLSCNTRNAIVIDIGTNYTTCVPIFDLRPLQQFIKYSKRGKRQVESRIPLPGSLYMPIFFDEEYNSKNCEVDETPVINLVKNIVESLPIDLRRPLRENIIIVNIEEAYETVIRNLFKLKMDTSKIQFPKNYWQAGSACAKILLHYKGSNIVGIERDEFYNNPHIAPDWFDYYFRTGVKRLQ

SEQ ID NO: 151 - protein, 698 aa, Saccharomyces cerevisiae
  misc_feature (0)...(0): Polypeptide Accession Number YDR108W
MVFSYEHYMNLLFHLDNSKETVPPEIAKRIISNAIAPVITVTSTPLFDKHIQETYKVDSLYMLLRFFGGCVSDRDQANEAKVGQHEHEVCDASDSTDSIPKNKNLEVPNLSKKGSRSRSNSLFQRDSTQSQYIRFTRPLGDLIETRDANDMLFNYHSLEVFLDNYLKLVAANTDEMVPHNLLKKSIYHSFFSLAISSTNNLSPYETFNHPILSLIALDISNGEVYEDARDLLVNFKNLNHNTENFPIFMNTNEMLPVFLLCYNDDSQEEFEKCQALAKKLKKQLFVESILLALWKDSFIYDENSVIQLHQPVMSSLEEILFFLQAPTQTTLSLALINSIYDMLDYLVYDLMIPFMKRKVSFWEETILQPRKSLFNGAKFFKKFMNKNPVNGNHQHNSLTRDSQGNEYFASSSSEFLMRKLADWSMMLSDFKTAYSTYESLMDDLDAFPKYLASCIEWCAVSLLMGAQSIVTVKMIKNDINPLIERALATYENCSRIQRGKGKESNSLDVTEPVRSYETRCMILASELFLSLSNTWTSTPYAIQYLETILDECKLGPCSQIMVWERLSDCYNLRVDPRIKHRVGAMKKDAKDTEDLRGEHKYSTDHFTDEDILSEGLTRRRKAAFFRLIAAKKWAEQKQWRQVSWCLKDIESTYSEIKFLHGNGLILSKLKNQLNLKDVDSAPRPSEKNLTRTSVSFIG

SEQ ID NO: 152 - protein, 566 aa, Saccharomyces cerevisiae
  misc_feature (0)...(0): Polypeptide Accession Number YDR110W
MTKPRYNDVLFDDDDSVPSESVTRKSQRRKATSPGESRESSKDRLLILPSMGESYTEYVDSYLNLELLERGERETPIFLESLTRQLTQKIYELIKTKSLTADTLQQISDKYDGVVAENKLLFLQRQYYVDDEGNVRDGRNNDKIYCEPKHVYDMVMATHLMNKHLRGKTLHSFLFSHFANISHAIIDWVQQFCSKCNKKGKIKPLKEYKRPDMYDKLLPMERIHIEVFEPFNGEAIEGKYSYVLLCRDYRSSFMWLLPLKSTKFKHLIPVVSSLFLTFARVPIFVTSSTLDKDDLYDICEEIASKYGLRIGLGLKSSARFHTGGILCIQYALNSYKKECLADWGKCLRYGPYRFNRRRNKRTKRKPVQVLLSEVPGHNAKFETKRERVIENTYSRNMFKMAGGKGLIYLEDVNTFALANEADNSCNNNGILHNNNIGNDNFEEEVQKQFDLTEKNYIDEYDDLAHDSSEGEFEPNTLTPEEKPPHNVDEDRIESTGVAAPMQGTEEPEKGDQKESDGASQVDQSVEITRPETSYYQTLESPSTKRQKLDQQGNGDQTRDFGTSMEL

SEQ ID NO: 153 - protein, 105 aa, Saccharomyces cerevisiae
  misc_feature (0)...(0): Polypeptide Accession Number YDR115W
MPLFARLCQPQSRRMFSSISSFSALSVLRPQTGMLLNSSPLKTPSFTPLGFGLIGQRRWKSRGNTYQPSTLKRKRTFGFLARAKSKQGSKILKRRKLKGRWFLSH

SEQ ID NO: 154 - protein, 1064 aa, Saccharomyces cerevisiae [sequence omitted]

SEQ ID NO: 155 - protein, 304 aa, Saccharomyces cerevisiae
  misc_feature (0)...(0): Polypeptide Accession Number YDR123C
MQQATGNELLGILDLDNDIDFETAYQMLSSNFDDQMSAHIHENTFSATSPPLLTHELGIIPNVATVQPSHVETIPADNQTHHAPLHTHAHYLNHNPHQPSMGFDQALGLKLSPSSSGLLSTNESNAIEQFLDNLISQDMMSSNASMNSESHLHIRSPKKQHRYTELNQRYPETHPHSNTGELPTNTADVPTEFTTREGPHQPIGNDHYNPPPFSVPEIRIPDSDIPANIEDDPVKVRKWKHVQMEKIRRINTKEAFERLIKSVRTPPKENGKRIPKHILLTCVMNDIKSIRSANEALQHILDDS

SEQ ID NO: 156 - protein, 1148 aa, Saccharomyces cerevisiae
  misc_feature (0)...(0): Polypeptide Accession Number YDR128W
MCSSINEGPYNSPTFGKSLSLKVDGGFNAVSINPSGRDIVLASRQGLYIIDLDDPFTPPRWLHHITPWQVADVQWSPHPAKPYWIVSTSNQKAIIWNLAKSSSNAIEFVLHGHSRAITDINFNPQHPDVLATCSVDTYVHAWDMRSPHRPFYSTSSWRSAASQVKWNYKDPNVLASSHGNDIFVWDLRKGSTPLCSLKGHVSSVNSIDFNRFKYSEIMSSSNDGTVKFWDYSKSTTESKRTVTTNFPIWRGRYLPFGEGYCIMPMVGGNNAVYLINLCDDDDSEQNKKTKLQPIYAFKGHSDRVIDFLWRSRHTCDGDYDDREFQLVTWSKDCDLKLWPISDSIYGKVNFDRGKRLEEKLPDYDYCSYNKEPENRENVQKNEFRRLRENFVTTSGLKKNKTNHITWLSGIRMNSATSQEDLFNETKIQNLGEEVSAIGHKFPKVVFEKISVSTRELCLTLNGPWSEENPDDYIFLRISINFPLNYPNKGDPPKFTIEENSNLTMSKRQEILSNLATIGQKYTDSNLYCLEPCIRFVLGEKVSLEDIEEGQEPLLNFDIADHIDFEELSSLDSSYSDSQNPENLSSQSDIESYKEALVFPDTSNQGLDFGRNLALDTTPVPNGCGSCWTATGELFCFFANEKKPEKKQNAIIKLSQKEAGVEKHPFKIEPQVLYDKEVDSSVITAADELKARPKRYVDTLGLGGGTNGDSRTYFDDETSSDDSFDSVADDWDDILRNDIIVRTKIPILRGNFKAFSSVHSESGKTVESTKKNKNLVISKNFSSLLSDRKELALEYLFMDATPEGFARNNALVAEKFDLDEISHCWQILSDMLIDQSDYDPYTTIWNNHPMGIKWFIKEAIVYFERQQNLQMLAMLCCVILSARRKKIPARYYGQELENMEGTIVFNDNESQNTSFWKGSDAFSTRSRSSTVTPNFYGNHLRGKNIHGGDNSSIRSDDHHARLRTHNTLNGSSKFTEPAQKQGSRAISSSPFHSRMPDIKVELLHDDIIEAYEQEDLLHLEVSDIPKFQTYIYQYSKLLFRWGLPLERVKILKVSTDFRSSYSSQGIPPNNNKKSPYNGVLTHWIENNEFGEEKFLARNCNYCDLRVTRSSFICGNCQHVLHSSCARIWWEIGDECPSGCGCNCPEMFDA

SEQ ID NO: 157 - protein, 495 aa, Saccharomyces cerevisiae
  misc_feature (0)...(0): Polypeptide Accession Number YDR132C
MSNSPTVATLSQEYFDPNIPQILPHEKMYKIQVGKSLFKISGASLSSDGPSFFTEYFSKKRSPSNNDDSNNDTMESNKNEVLFIDRSAEVFEWIYQHLQGYIIEIKDEVQYTMLFADAMYYNLPRLRSLLKETDYYFTNIGGQSFKIAKNLFRREGDSPNYFEIYAATVYIDVEELIISKKLLRPPSHSAPYIPRSSEYFKDLLTLLGGASIDLDDNKRNALIKECRYYRLLNLEQRLIKSHISYNPITRKEEICLLLKDLSKKGITFPASSAFSTSPYFEDDFCSINECDSLSKTREQPANKKIKLDMTEKYNDSWNMLCYKRPFLDKHPRELIFQINSTDCTIILNKESQSIHVDITGESAYKFEALFGSHLPNTPSGAPKLKNYQYRFPSDSTQTKIETHYLLPACIYLCDLDINGIKISQVQTLLTDKNKFNDRVIDVSDPLDLRFCSGLKLYLRKSLWKLAVKDGNIMLIAIKAIAFNGTKEYYKGYEYL

SEQ ID NO: 158 - protein, 221 aa, Saccharomyces cerevisiae
  misc_feature (0)...(0): Polypeptide Accession Number YDR140W
MLPTPYVKCDYDKVYEPAEDSFLILDCLEKEHDFLKQKFGNRLAIVCEIGSGSGIVTTFLMQNKIIPQENSIHLAVDINPWALEATLDTAKLNSCKSSFLEVIQADLNSSIRNNQVDVLIFNPPYVPAECVPDVPGSREEADQWLDLALLGGKDGMAITDKLLRQLEQILSPDGVAYILFCARNKPKEVIKRFVDTYKWNVKLIETRKAGWEVLSVYSFTR

SEQ ID NO: 159 - protein, 375 aa, Saccharomyces cerevisiae
  misc_feature (0)...(0): Polypeptide Accession Number YDR142C
MLRYHMQGFSGYGVQYSPFFDNRLAVAAGSNFGLVGNGKLFILEIDRSGRIVEVNSFLTQDCLFDLAWNESHENQVLVAQGDGTLRLFDTTFKEFPIAIFKEHEREVFSCNWNLVNRQNFLSSSWDGSIKIWSPLRKQSLMTLTPRPLEITKMVDPLNAIILKKKSFTGISKNRNCVYQAQFSPHDQNLVLSCSGNSYASLFDIRLPSGKNQNNFLVHSGLEALTCDFNKYRPYVVATGGVDNAIRIWDIRMLNKNESATIKRTVPGQLHNSSCINEIPNAHGLAIRKVTWSPHHSNILMSASYDMTCRIWRDLSNDGAKETYKTNSTDATKGSIFNFTQHSEFVFGADWSLWGKPGYVASTAWDGNLFVWNGLG

SEQ ID NO: 160 - protein, 539 aa, Saccharomyces cerevisiae
  misc_feature (0)...(0): Polypeptide Accession Number YDR145W
MSSNPENSGVNANNNTGTGNADAITGAQQNMVLQPRQLQEMAAKFRTLLTEARNVGETTPRGKELMFQAAKIKQVYDALTLNRRRQQAAQAYNNTSNSNSSNPASIPTENVPNSSQQQQQQQQQTRNNSNKFSNMIKQVLTPEENQEYEKLWQNFQVRHTSIKEKETYLKQNIDRLEQEINKQTDEGPKQQLQEKKIELLNDWKVLKIEYTKLFNNYQNSKKTFYVECARHNPALHKFLQESTQQQRVQQQRVQQQQQQQQQQQQQQQQQQQQQQQRQGQNQRKISSSNSTEIPSVTGPDALKSQQQQQNTITATNNPRGNVNTSQTEQSKAKVTNVNATASMLNNISSSKSAIFKQTEPAIPISENISTKTPAPVAYRSNRPTITGGSAMNASALNTPATTKLPPYEMDTQRVMSKRKLRELVKTVGIDEGDGETVIDGDVEELLLDLADDFVTNVTAFSCRLAKHRKSDNLEARDIQLHLERNWNIRIPGYSADEIRSTRKWNPSQNYNQKLQSITSDKVAAAKNNGNNVASLNTKK

SEQ ID NO: 161 - protein, 709 aa, Saccharomyces cerevisiae
  misc_feature (0)...(0): Polypeptide Accession Number YDR146C
MDTSNSWFDASKVQSLNFDLQTNSYYSNARGSDPSSYAIEGEYKTLATDDLGNILNLNYGETNEVIMNEINDLNLPLGPLSDEKSVKVSTFSELIGNDWQSMNFDLENNSREVTLNATSLLNENRLNQDSGMTVYQKTMSDKPHDEKKISMADNLLSTINKSEINKGFDRNLGELLLQQQQELREQLRAQQEANKKLELELKQTQYKQQQLQATLENSDGPQFLSPKRKISPASENVEDVYANSLSPMISPPMSNTSFTGSPSRRNNRQKYCLQRKNSSGTVGPLCFQELNEGFNDSLISPKKIRSNPNENLSSKTKFITPFTPKSRVSSATSNSANITPNNLRLDFKINVEDQESEYSEKPLGLGIELLGKPGPSPTKSVSLKSASVDIMPTIPGSVNNTPSVNKVSLSSSYIDQYTPRGKQLHFSSISENALGINAATPHLKPPSQQARHREGVFNDLDPNVLTKNTDNEGDDNEENEPESRFVISETPSPVLKSQSKYEGRSPQFGTHIKEINTYTTNSPSKITRKLTTLPRGSIDKYVKEMPDKTFECLFPGCTKTFKRRYNIRSHIQTHLEDRPYSCDHPGCDKAFVRNHDLIRHKKSHQEKAYACPCGKKFNREDALVVHRSRMICSGGKKYENVVIKRSPRKRGRPRKDGTSSVSSSPIKENINKDHNGQLMFKLEDQLRRERSYDGNGTGIMVSPMKTNQR

SEQ ID NO: 162 - protein, 463 aa, Saccharomyces cerevisiae
  misc_feature (0)...(0): Polypeptide Accession Number YDR148C
MLSRATRTAAAKSLVKSKVARNVMAASFVKRHASTSLFKQANKVESLGSIYLSGKKISVAANPFSITSNRFKSTSIEVPPMAESLTEGSLKEYTKNVGDFIKEDELLATIETDKIDIEVNSPVSGTVTKLNFKPEDTVTVGEELAQVEPGEAPAEGSGESKPEPTEQAEPSQGVAARENSSEETASKKEAAPKKEAAPKKEVTEPKKADQPKKTVSKAQEPPVASNSFTPFPRTETRVKMNRMRLRIAERLKESQNTAASLTTFNEVDMSALMEMRKLYKDEIIKKTGTKFGFMGLFSKACTLAAKDIPAVNGAIEGDQIVYRDYTDISVAVATPKGLVTPVVRNAESLSVLDIENEIVRLSHKARDGKLTLEDMTGGTFTISNGGVFGSLYGTPIINSPQTAVLGLHGVKERPVTVNGQIVSRPMMYLALTYDHRLLDGREAVTFLKTVKELIEDPRKMLLW

SEQ ID NO: 163 - protein, 325 aa, Saccharomyces cerevisiae
  misc_feature (0)...(0): Polypeptide Accession Number YDR151C
MMPNVAPNSYYLNIPNANSTSTTTSSIFSDLNKEYESKIKEIEEYYIKTLLNENTDNDDSSSSEGHNINETDILSEYSPRPSPWLPSKPNCYHPLGDFKDLIISDSRPTNTLPINNPFAGNNNISTLATTEKKRKKRSLEVEINPTYTTSAFSLPLTAENLQKLSQVDSQSTGLPYTLPIQKTTKLEPCRRAPLQLPQLVNKTLYKTELCESFTIKGYCKYGNKCQFAHGLNELKFKKKSNNYRTKPCINWSKLGYCPYGKRCCFKHGDDKDVEIYQNANDGRSKDTALTPLPTSLAPSNNDNITNLSKPRNLHTSVKALQRMTW

SEQ ID NO: 164 - protein, 265 aa, Saccharomyces cerevisiae
  misc_feature (0)...(0): Polypeptide Accession Number YDR152W
MDYKEEQKQELEVLESIYPDELRIINDEYPKIKFEVAIKLELDTGDSTSVLTKEHTIIAEFKLPENYPDEPCLISLEAQEVALNDNEEDNEEDEDEVEYDDHGNKVLKKFENLPDLISFKGYLPELTVQLESQIETDMLLGMQMCFALISSIKERCEQWYSEQLNKLEKQYELEAQEREKKEQAKFHGTKVTRESYLEWRSKFRQELKLDERDQVRRMKAHHGKLTGKQMFEQGVVGTGDEYMEEDDASVDDVAKGLAKTEIANQ

SEQ ID NO: 165 - protein, 236 aa, Saccharomyces cerevisiae
  misc_feature (0)...(0): Polypeptide Accession Number YDR162C
MATMETTTQKDTNILKSGLKKTIGVLNEAVLQNGREVEAVQAGNSDTMEDTETTTIGYISIKDYAYADSNPLHYGYFDGDNEEDEMVSDSSNGEDTYNKRQSITLPDDYIVNQRAVALYDFEPENDNELRLAEGDIVFISYKHGQGWLVAENESGSKTGLVPEEFVSYIQPEDGENEVENKARPFYLTHLITQSVSPKNNIDNTNEDEYDDNDEWEDIDDVAEVEADMKTKLDISD

SEQ ID NO: 166 - protein, 206 aa, Saccharomyces cerevisiae
  misc_feature (0)...(0): Polypeptide Accession Number YDR167W
MDFEEDYDAEFDDNQEGQLETPFPSVAGADDGDNDNDDSVAENMKKKQKREAVVDDGSENAFGIPEFTRKDKTLEEILEMMDSTPPIIPDAVIDYYLTKNGFNVADVRVKRLLALATQKFVSDIAKDAYEYSRIRSSVAVSNANNSQARARQLLQGQQQPGVQQISQQQHQQNEKTTASKVVLTVNDLSSAVAEYGLNIGRPDFYR

SEQ ID NO: 167 - protein, 246 aa, Saccharomyces cerevisiae
  misc_feature (0)...(0): Polypeptide Accession Number YDR174W
MTTDPSVKLKSAKDSLVSSLFELSKAANQTASSIVDFYNAIGDDEEEKIEAFTTLTESLQTLTSGVNHLHGISSELVNPIDDDKDAIIAAPVKAVRRKIERDPNAPKKPLTVFFAYSAYVRQELREDRQKAGLPPLSSTEITQEISKKWKELSDNEKEKWKQAYNVELENYQREKSKYLEAKKNGTLPPASLENGPTHAPVPIPFSLQHAAEPPVEKRPHDDDGSSEKKKKKKKKDKKKDKSNSSI

SEQ ID NO: 168 - protein, 162 aa, Saccharomyces cerevisiae
  misc_feature (0)...(0): Polypeptide Accession Number YDR179C
MVMREETIKSLEDPYKYHYKEEWLNTKDPDEQQLFEIFAFGNIKDLPENIILTSLMRSKLEKLTLVTLSEIYNELSYELIKEECQIEDDGIIESHLIQLQNIFKAEMDSVSKSMKFSRRFDCRDVYCHEKELTIIKNPRVTKEYLVQNLRSWETKLKQNILE

SEQ ID NO: 169 - protein, 230 aa, Saccharomyces cerevisiae
  misc_feature (0)...(0): Polypeptide Accession Number YDR183W
MEDKLDRYYTNVLSNAEKDKHTTVDSDDKSSGEENLDELLNELDRELDEDHEFLSAYRSERLQQISDHLKQVKKNVEDDGYGRLQCIDNEADAIQICTKTTMVVIHFELETFGKCQYMNEKLENLAKRYLTTRFIKVNVQTCPFLVNKLNIKVLPFVVGYKNGLEKVRYVGFSKLGNDPNGFDIRRLEQSLAHSGVIEDTFEIRKHSSVNTERFASTNHDRSESDSDLDI

SEQ ID NO: 170 - protein, 604 aa, Saccharomyces cerevisiae
  misc_feature (0)...(0): Polypeptide Accession Number YDR200C
MVELEKRRRPPPQLQHSPYVRDQSNSQGMTKTPETSPPKRPMGRARSNSRSSGSRSNVDIDQYTIPPGLDLLPTASSPPSVHQVSQQQQLSPILANKIRSPFENQSQDQNDNSIDPTPAGQVTIPVEAVSPPALDELSKFQNGSTETLFRTGSPRKKHTHIIILKSLNATFETKFLVVPFKPDGLKLGRPVTNSVNKNNSGSKRDLFSQQVRPDNGNFDSRVLSRNHACLSCDPTSGKIYIRDLKSSNGTFVNGVKIRQNDVELKVGDTVDLGTDIDSKFEHRKISAYVEEISVIPLMNTVSDPTNLVMKKQDHTNKNNGNSTNINGIKIDRGHHNQHIPIRSHLKENYTEAGVTSATTAQRAAFEAAMFGDINNSELDDDILGPETEVLSGIFINNSAGTSINLINMIKTLTTELSLEKQELEKLHSMQNFMQNYTINLDFINKHMIDMNEKHLLKLSTALQKTLSENNDALLKESEDQLKEIKQQNNKVKSACSLKEKQNHEKLQELESELRELNLQIEEERGKNLVLTQSNFNGGINNDNNAKVKQNDSREEKKDTEDTLISTEELGVVEGKRTRVSKGMLFGVVAISFGLVATAVKQLPQ

SEQ ID NO: 171 - protein, 165 aa, Saccharomyces cerevisiae
  misc_feature (0)...(0): Polypeptide Accession Number YDR201W
MTDALEQSVLALEGTVSVLKDSVESLKCANEPSTNLASTMLQTKRVFRLVPEYDVERSKLDLIEEVEPLVRTLGDKLRKSMGRMQRELDTLQQTYELNDLRLKKNISMDDDDALNSPDMGQEYEGRDADDVVMMASSTNEELEELKKLKEKKKQLENKLEILKQK

SEQ ID NO: 172 - protein, 884 aa, Saccharomyces cerevisiae
  misc_feature (0)...(0): Polypeptide Accession Number YDR206W
MEPSNTQKEDLPTAFNGIKSQLNSILKSNQLFQDYALLNGFLAFVHSKLNAAILTSIESQCGKSFAADLDSFDQSSISSILDFSWESVHYPIFKWFQMWRNYILFEKENKKQQTKFIDFRKMNSKMLKFFKTVQNFYVNVINTVYKKYDISVLLPKRIIQDLKLSDIENTTNVGDILAVKTFNSSSPLAHLIPTLFHRCLLFLGTAYRYKTLLEEISNKYSISNFKKSLDFFRLASLVLPSAGETYSQAGAIFLQTGNLGIAVFNFVKGMMTKMPSPVSIKNFGALMVDNKSSLNRSLHTTIMNTYLQESKGPRTPAKEILEFYFLGLFGSVWSPTSWRDDTKPNQLNNGIKLRHLENALYETMSARYLNNIKTIFHNLIITIGGFHLLLKRRSDVSAKTLKDLRSNELDYLNFAFKYIAHILNDIVKESWSENPEVSEILGMVRIINCWIKANPMVLQYSQSNLEFVNALAYLINDIVKKKPSPSFSITEHIPKRTYWFEEDLMVKGLSFVNFQLSDFDDYEKILEMDHSLDRLIGNPPLCDKLSASSEMLLRLQAVVNISSQLLQNNNCGVEWSDNKSRYIFNKKIGFKETVKNSMKTSKQSNEKAKLQRKNKPSTTNGSISMADLERQMRSSSLDSFSPTMGYSGSSVPMAPDTFNVKPSGTITGNKVNVELLKIELSGQNADGAITNISPGYSNAAISSSNSTDESSFDLNNILSSMQQKHAEKSFAKSMQGVNEQIPANDVCHQAQRPMQGGLYSSQQPSSMSSLNSAYQNASMPPSASMVSYPYPFLNQQGQGVFPPYNAQNLQWQSEAYSLKSMNFANPTWLGDQYQTSAPSSAYAQAQRQMFQQPMQQDVGKYMQFPFDAQSNTDSMRGNSRNNMF

SEQ ID NO: 173 - protein, 836 aa, Saccharomyces cerevisiae
  misc_feature (0)...(0): Polypeptide Accession Number YDR207C
MLDKARSQSKHMDESNAAASLLSMETTANNHHYLHNKTSRATLMNSSQDGKKHAEDEVSDGANSRHPTISSASIESLKTTYDENPLLSIMKSTCAPNNTPVHTPSGSPSLKVQSGGDIKDDPKENDTTTTTNTTLQDRRDSDNAVHAAASPLAPSNTPSDPKSLCNGHVAQATDPQISGAIQPQYTATNEDVFPYSSTSTNSNTATTTIVAGAKKKIHLPPPQAPAVSSPGTTAAGSGAGTGSGIRSRTGSDLPLIITSANKNNGKTTNSPMSILSRNNSTNNNDNNSIQSSDSRESSNNNEIGGYLRGGTKRGGSPSNDSQVQHNVHDDQCAVGVAPRNFYFNKDREITDPNVKLDENESKINISFWLNSKYRDEAYSLNESSSNNASSNTDTPTNSRHANTSSSITSRNNFQHFRFNQIPSQPPTSASSFTSTNNNNPQRNNINRGEDPFATSSRPSTGFFYGDLPNRNNRNSPFHTNEQYIPPPPPKYINSKLDGLRSRLLLGPNSASSSTKLDDDLGTAAAVLSNMRSSPYRTHDKPISNVNDMNNTNALGVPASRPHSSSFPSKGVLRPILLRIHNSEQQPIFESNNSTAVFDEDQDQNQDLSPYHLNLNSKKVLDPTFESRTRQVTWNKNGKRIDRRLSAPEQQQQLEVPPLKKSRRSVGNARVASQTNSDYNSLGESSTSSAPSSPSLKASSGLAYTADYPNATSPDFAKSKGKNVKPKAKSKAKQSSKKRPNNTTSKSKANNSQESNNATSSTSQGTRSRTGCWICRLRKKKCTEERPHCFNCERLKLDCHYDAFKPDFVSDPKKKQMKLEEIKKKTKEAKRRAMKKK

SEQ ID NO: 174 - protein, 350 aa, Saccharomyces cerevisiae
  misc_feature (0)...(0): Polypeptide Accession Number YDR214W
MVVNNPNNWHWVDKNCIGWAKEYFKQKLVGVEAGSVKDKKYAKIKSVSSIEGDCEVNQRKGKVISLFDLKITVLIEGHVDSKDGSALPFEGSINVPEVAFDSEASSYQFDISIFKETSELSEAKPLIRSELLPKLRQIFQQFGKDLLATHGNDIQVPESQVKSNYTRGNQKSSFTEIKDSASKPKKNALPSSTSTSAPVSSTNKVPQNGSGNSTSIYLEPTFNVPSSELYETFLDKQRILAWTRSAQFFNSGPKLETKEKFELFGGNVISELVSCEKDKKLVFHWKLKDWSAPFNSTIEMTFHESQEFHETKLQVKWTGIPVGEEDRVRANFEEYYVRSIKLTFGFGAVL

SEQ ID NO: 175 - protein, 127 aa, Saccharomyces cerevisiae
  misc_feature (0)...(0): Polypeptide Accession Number YDR215C
MKTPPNQEKNNEKISLLFSSQRLTIDVHPSSVYHIVLSSNNADRHQVTLSFTARSRMMPLTRARLSAIILACSACSLTPWSSLPSPPAFPFPLSCQGAVHTTQAHPAPKNRGKTTALWFRSFPPMAL

SEQ ID NO: 176 - protein, 423 aa, Saccharomyces cerevisiae
  misc_feature (0)...(0): Polypeptide Accession Number YDR218C
MFPMKDHSALEQHTLSRDELRRRKGYKKGLQLSILLLGEKGSGKSTFLNNLCGQDISLSDGDYDDDDDKVTNNVTPENGNAIEDIDPGYKTAHLSPGLKLVTRRVYLNDELGVPITLDIILFPGCGDNVDNSQSSVVIKNYLDQQFANVLKEEVRIKRNTKETDGRPHVCLYFLKSTPRGVKKFDIELMKTICDKVNLIPIIPKADGLTETELNLHKDIVRQEISQNNIRVFDFKSDTLGETLALYDMDIDSSSAKSKYDNDTKIKEISPFAIVCSKTFNKNSENRVEHIRTYEWGSLVVEDQNTSDFIYLKAILLGSHLQELKDVTNNVLYENYRAKVLTEKKNNYDIPNYSYIDETSRGSVSNVSTRRNSASRTLGNPDTNDENAYQIHKEIDEKNRIIEDYQRKIDLLEKMLAAPHQNKV

SEQ ID NO: 177 - protein, 132 aa, Saccharomyces cerevisiae
  misc_feature (0)...(0): Polypeptide Accession Number YDR225W
MSGGKGGKAGSAAKASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKATKASQEL

SEQ ID NO: 178 - protein, 218 aa, Saccharomyces cerevisiae
  misc_feature (0)...(0): Polypeptide Accession Number YDR236C
MFTWTIYVSLLLVLAGTFLMNRNTNTDIIDTFKREVDLPIPAQPGPPFPLVTDYCDIVCGFGRGSAELGIPTANVPINQLPKGINDLDLGVYFGFAHIKTVDGQELSVETRRDGRTVVYNYGQYLSEANDDLSVLPMVLSVGKNPFYGNDFKTMELHIIHDFKNDFYGARVKFNILGHIRPELNYTTKEALIEDINIDIRTAQTVLATPPYQVFKQQL

SEQ ID NO: 179 - protein, 421 aa, Saccharomyces cerevisiae
  misc_feature (0)...(0): Polypeptide Accession Number YDR255C
MSELLDSFETEFAKFYTDSNLEETNLQKCLDHTHEFKSQLKKLKAHLNKHIQESKPEVYNKLSDKEKQKFKRKRELIIEKLSKSQRQWDHSVKKQIKYVSQQSNRFNKSTLNKLKEFDIDSVYVNKLPKETMENVNEAIGYHILRYSIDNMPLGNKNEAFQYLKDVYGITNKESTEFIEMGQIVHDLKKGDTESCLKWCSNEMESLSSNHTALSSLKFDLYTLSAMQIVKHGNPVELYYQITQNAPLDCFRHREKELMQNVVPLLTKSLIGQPIEDIDSKVNKELKECTSLFIKEYCAAKHIFFDSPLFLIVLSGLISFQFFIKYKTIRELAHVDWTTKDELPFDVKLPDFLTHFHPIFICPVLKEETTTENPPYSLACHHIISKKALDRLSKNGTITFKCPYCPVNTSMSSTKKVRFVML

SEQ ID NO: 180 - protein, 330 aa, Saccharomyces cerevisiae
  misc_feature (0)...(0): Polypeptide Accession Number YDR267C
MASINLIKSLKLYKEKIWSFDFSQGILATGSTDRKIKLVSVKYDDFTLIDVLDETAHKKAIRSVAWRPHTSLLAAGSFDSTVSIWAKEESADRTFEMDLLAIIEGHENEVKGVAWSNDGYYLATCSRDKSVWIWETDESGEEYECISVLQEHSQDVKHVIWHPSEALLASSSYDDTVRIWKDYDDDWECVAVLNGHEGTVWSSDFDKTEGVFRLCSGSDDSTVRVWKYMGDDEDDQQEWVCEAILPDVHKRQVYNVAWGFNGLIASVGADGVLAVYEEVDGEWKVFAKRALCHGVYEINVVKWLELNGKTILATGGDDGIVNFWSLEKAA

SEQ ID NO: 181 - protein, 365 aa, Saccharomyces cerevisiae
  misc_feature (0)...(0): Polypeptide Accession Number YDR273W
MGKKNRKGKENNAAKTSFLKVENIKNTNSGLELPSQDYTNVEEKESSPKTDFPLITKEHVNTKTDSNILDYPTIGDLVSSVEKLCVLKELKIAFPEVDDTLIKAILIASQGVLEPAFNSLLYYSSPEENTDFALPMKPISVEDYSKINVSEILQREIFDDIEDEFSGQGINGSMVISKIESELSSLAEHIGNISTPGSNREVAESTRNVAVAEGHNTILSNEDSILKGKEKGKEEEKEKGEEKGVNSLKGAAVKVVAKSLKNNRIPVTVKRNEPSNNLFDVLNCDESEEEEEQDVETNTSNQERKNQGGNTEVPEAQRDSADRLPAKDDGGYKSAFGTDSCGLFAADAKDEKKQVHPSRQELSFT

SEQ ID NO: 182 - protein, 350 aa, Saccharomyces cerevisiae
  misc_feature (0)...(0): Polypeptide Accession Number YDR279W
MTVSNIGGEERLIILPDDYETSKTINTFTLPPPSNITSKPRIELFENINGKLYEIRSFQFGKGPSYSHEEDLANDKYHYTKENHPIKSTFIVNTSDPTDGYVFNSSKIHFCSLYDIAFSLIGFYYRNSVSADEQDYSNSSDTGENQKSNSKTNEKFLTVRDYHDFLTDNHDKNWENISLSRLKSGLAKVSETIEEAGDVYYKITSAMITQFLLGKVSKIVENFPPSIPTLKNAPTEIKQCYKVVMATNLLVSLIPRAAYHNLLTFSPTMDSGCLNPDIKASFIELENYETTNELQNAERELLMKSAMNVGLNSNGRVSLPVKKVTKKIVQNKKPKVAIGKGAIDGFFKRK

SEQ ID NO: 183 - protein, 621 aa, Saccharomyces cerevisiae
  misc_feature (0)...(0): Polypeptide Accession Number YDR292C
MFDQLAVFTPQGQVLYQYNCLGKKFSEIQINSFISQLITSPVTRKESVANANTDGFDFNLLTINSEHKNSPSFNALFYLNKQPELYFVVTFAEQTLELNQETQQTLALVLKLWNSLHLSESILKNRQGQNEKNKHNYVDILQGIEDDLKKFEQYFRIKYEESIKQDHINPDNFTKNGSVPQSHNKNTKKKLRDTKGKKQSTGNVGSGRKWGRDGGMLDEMNHEDAAKLDFSSSNSHNSSQVALDSTINKDSFGDRTEGGDFLIKEIDDLLSSHKDEITSGNEAKNSGYVSTAFGFLQKHVLGNKTINESDLKSVLEKLTQQLITKNVAPEAADYLTQQVSHDLVGSKTANWTSVENTARESLTKALTQILTPGVSVDLLREIQSKRSKKDEEGKCDPYVFSIVGVNGVGKSTNLSKLAFWLLQNNFKVLIVACDTFRSGAVEQLRVHVENLAQLMDDSHVRGSKNKRGKTGNDYVELFEAGYGGSDLVTKIAKQAIKYSRDQNFDIVLMDTAGRRHNDPTLMSPLKSFADQAKPDKIIMVGEALVGTDSVQQAKNFNDAFGKGRNLDFFIISKCDTVGEMLGTMVNMVYATGIPILFVGVGQTYTDLRTLSVKWAVNTLMS

SEQ ID NO: 184 - protein, 534 aa, Saccharomyces cerevisiae
  misc_feature (0)...(0): Polypeptide Accession Number YDR299W
MEKSLADQISDIAIKPVNKDFDIEDEENASLFQHNEKNGESDLSDYGNSNTEETKKAHYLEVEKSKLRAEKGLELNDPKYTGVKGSRQALYEEVSENEDEEEEEEEEEEKEEDALSFRTDSEDEEVEIDEEESDADGGETEEAQQKRHALSKLIQQETKQAINKLSQSVQRDASKGYSILQQTKLFDNIIDLRIKLQKAVIAANKLPLTTESWEEAKMDDSEETKRLLKENEKLFNNLFNRLINFRIKFQLGDHITQNEEVAKHKLSKKRSLKELYQETNSLDSELKEYRTAVLNKWSTKVSSASGNAALSSNKFKAINLPADVQVENQLSDMSRLMKRTKLNRRNITPLYFQKDCANGRLPELISPVVKDSVDDNENSDDGLDIPKNYDPRRKDNNAIDITENPYVFDDEDFYRVLLNDLIDKKISNAHNSESAAITITSTNARSNNKLKKNIDTKASKGRKLNYSVQDPIANYEAPITSGYKWSDDQIDEFFAGLLGQRVNFNENEDEEQHARIENDEELEAVKNDDIQIFG

SEQ ID NO: 185 - protein, 140 aa, Saccharomyces cerevisiae
  misc_feature (0)...(0): Polypeptide Accession Number YDR308C
MTDRLTQLQICLDQMTEQFCATLNYIDKNHGFERLTVNEPQMSDKHATVVPPEEFSNTIDELSTDIILKTRQINKLIDSLPGVDVSAEEQLRKIDMLQKKLVEVEDEKIEAIKKKEKLLRHVDSLIEDFVDGIANSKKST

SEQ ID NO: 186 - protein, 642 aa, Saccharomyces cerevisiae
  misc_feature (0)...(0): Polypeptide Accession Number YDR311W
MSHSGAAIFEKVSGIIAINEDVSPAELTWRSTDGDKVHTVVLSTIDKLQATPASSEKMMLRLIGKVDESKKRKDNEGNEVVPKPQRHMFSFNNRTVMDNIKMTLQQIISRYKDADIYEEKRRREESAQHTETPMSSSSVTAGTPTPHLDTPQLNNGAPLINTAKLDDSLSKEKLLTNLKLQQSLLKGNKVLMKVFQETVINAGLPPSEFWSTRIPLLRAFALSTSQKVGPYNVLSTIKPVASSENKVNVNLSREKILNIFENYPIVKKAYTDNVPKNFKEPEFWARFFSSKLFRKLRGEKIMQNDRGDVIIDRYLTLDQEFDRKDDDMLLHPVKKIIDLDGNIQDDPVVRGNRPDFTMQPGVDINGNSDGTVDILKGMNRLSEKMIMALKNEYSRTNLQNKSNITNDEEDEDNDERNELKIDDLNESYKTNYAIIHLKRNAHEKTTDNDAKSSADSIKNADLKVSNQQMLQQLSLVMDNLINKLDLNQVVPNNEVSNKINKRVITAIKINAKQAKHNNVNSALGSFVDNTSQANELEVKSTLPIDLLESCRMLHTTCCEFLKHFYIHFQSGEQKQASTVKKLYNHLKDCIEKLNELFQDVLNGDGESMSNTCTAYLKPVLNSITLATHKYDEYFNEYNNNSN

SEQ ID NO: 187 - protein, 286 aa, Saccharomyces cerevisiae
  misc_feature (0)...(0): Polypeptide Accession Number YDR313C
MVIKEDCINNLARWQADEEAHSCFQCKTNFSFLVRRHHCRCCGRIFCSSCTENFVNYNKKRVHALQKKNSDVESPPYRTCNECYDNLLHLNLLVSSTNRDVRLSQTSVPPNALALSAPDSNTDEDAEILEDSVDQSGTACRSEESSQNEEDHFCPICNSDLTQFPDEEETRKHVEDCIQRAENAQQHTNTSDAADDSVKESPAFQNRMLVYKISPNTTDNAIKECPICFENMEPGEKVGRLECLCVFHYKCIKNWFHKRAQMTAAQKGNGHAFVKRNFCPFHDAVF

SEQ ID NO: 188 - protein, 281 aa, Saccharomyces cerevisiae
  misc_feature (0)...(0): Polypeptide Accession Number YDR315C
MQVIGRGGANILIDYGDPTWLWRCCIRWPDLLSSNNSYTIKNISYIKDYVEPLLHGLLCPMYLIDVDIEAIRPILSDFILNLDDKVVKVIKIKNLTNNTSNLILNNHFLKSYCSQNLQTVILELKPKWLYYDTDYCRNCTHNAFKGRGTKYCYNQLLMNPAHLELIFGECNIFPVKFKDAMHEYLRNDNNIFKILYDLQKKLTKNTTPISDIKSINDVNDEHLLLMTLRDVTCFIEWNSAENALHVNIIDVDLKPKEKWTHWTKTYSQLTSSQKIYHTSNK

SEQ ID NO: 189 - protein, 1438 aa, Saccharomyces cerevisiae
  misc_feature (0)...(0): Polypeptide Accession Number YDR326C
MRDEATRKKRSFSDGHFFKKLKLMSRKKQPVMERSKTTRTRKESTNSAAKSSLSLRRANNGRKTIAKRRVLTDIGSTNEGVAGNSGSNSPAQYSHTPHFSDSIPPLPLELPDIVSIRSSRSHISNKSNKNKHGIDLTFIPRRSLQNSKAGLKKPNTSPQGYFNIPVTIDRASEKVKHTDTKNTFNSSSSENERPVLSILQKDDSQSSSHPAIDSMSAPNNINNNNDIENSSNSLFDTILSIAHSAISHVPKISALNTEIQREFSHSGESHTGSTRHPYFHIHHAQQQHPLSQQQGPLPVSENANQNPNDTVLIHSPSANTAHRSSSFLRHLDYLLSPTSGPASDKHTQVEEGDDEEELSPLSKAFLSPSTQLVPTNTSTTPLSGSLTPNNRNVNANSNSETENDNDRDDRSNVGKVKFQPLKVHEPAISTFGKGNLTLEAVAGSSDIDNTTIDLDENNTNNNPNASSTNLSHISKSNVNNNLGPKELNTSYRNSTYIDMARFENSQSNLSSHRARSKTLPANKALENAVGDEGNSKRNSRYSSYSNDMAFDDADERKFRSMSKKFLNRRSFSPSNLGNKVIPGINLRNSFNKNRNSSSDFFSTNQGQQMPRTSTAGSGNIHAIMGLDSGNDDFKLEGIEYASEKKNSEFHTLFKDCDINPNEKLIVDHSCALSRDILLQGRMYISDAHIGFFSNILGWVSTVFIPFKEIVQIEKKTTAGIFPNGIVIDTLHTKYIFASFMSRDATFDLITDVWNQIILGKKYRNGFGNNDDGTISDSSSAFFDDSDDNDDDGDLDDDDPDINSTDMTSSDDIDADVFNESNDLGKNQKSTNYLLGPNKHSPTTADFKPSNNDHLVIEANINAPLGKVVNLLYGEDVSYYERILKAQKNFEISPIPNNFLTKKIRDYAYTKPLSGSIGPSKTKCLITDTLEHYDLEDYVKVLSITKNPDVPSGNIFSVKTVFLFSWDKNNSTKLTVYNSVDWTGKSWIKSMIEKGTFDGVADTTKIMISEIKKILSDEDSNINSKHQASNNESEEEIINLPTIGPPVHDPTEPDFQKGKDDTVIDEKINIPVPLGTVFSLLYGDDTSYIKKIIENQNNFNVCDIPKFVNNAREITYTKKLNNSFGPKQTKCIVTETIEHMDLNSFFMVKQIVRSPDVPYGSSFSVHTRFFYSWGDHNTTNMKVVTNVVWTGKSMLKGTIEKGSIDGQRSSTKQLVDDLKKIISNASSTKKKSRRRGKTVNKRKSSPSTIKNEKNEENFEDTSTKNSFFSAFSMLQQVNITSVQGIMTIISFFICLIFFFRLLFHSKNTSNIQIITPGTILINGNEYNYVPNFKTLYHVYEDNIIKDARRKDSNKNNIVTDTEGLIWDWLIDRGNGTVQNSVLSNHIKESNNKKVKLVNGVSDHKIQQLVESIKITELQLQEMKELLAQTDNTSATNQLL

SEQ ID NO: 190 - protein, 194 aa, Saccharomyces cerevisiae
  misc_feature (0)...(0): Polypeptide Accession Number YDR328C
MVTSNVVLVSGEGERFTVDKKIAERSLLLKNYLNDMHDSNLQNNSDSESDSDSETNHKSKDNNNGDDDDEDDDEIVMPVPNVRSSVLQKVIEWAEHHRDSNFPDEDDDDSRKSAPVDSWDREFLKVDQEMLYEIILAANYLNIKPLLDAGCKVVAEMIRGRSPEEIRRTFNIVNDFTPEEEAAIRRENEWAEDR

SEQ ID NO: 191 - protein, 1224 aa, Saccharomyces cerevisiae
  misc_feature (0)...(0): Polypeptide Accession Number YDR335W
MDSTGASQIVSALDVIYSPKSNNSQRQEAQKFLDEVKLCSESPFWGYEIALQNPTNSILKYFGLGLLDHAVKKNWNDYDEGKRVALRKWVMELNFGVQDYDTRYIKEKLATLWVEVAKRTWGEALKQTNPTEEQLLTSWVDMDNNLFELWNINQSSRELALIIFRILFEDVFLLDDLIVLKRMTVIQPLCVMIVCPIEVFAIKYKFSDKWTKFKANEEGWFSVWIPELNNALQQNNSEYIIRLLETLKTCLNWPLTEVIVRNDVLSSLLTCLSSNIPRAQSMALDSIHILLTRPYSNESHYQMTIDRVFDNMDLLDSVYESLLFDPTDDIDETKYPIIKKFVDMISCLYVCVPKIKETNGQIQKYFKLVLKTTYNPSLIVSGLTLDLWCTCLRNDEYLPKLEKYVIPDLLQFAADALVYYEQIDGHISKKFAEIDFQSKSEFQTFCSTYRKRIRDIIRLISCVELDLTYDWLNNRLNNYFSSPFGQQVLSSTFLDHKLEPYLGALSQYMIVECFINGCIRWKIWYPTGDDYDEKLDSILQKLEILSNQLIALNLREPLLLKKQIQNFALFLTMLKDNVLFTLLEKIITSATMDYPEINLEERGAESDAVRDLRYACGIELNRMALLMPESLKKIYPDLESVIARIMPNLSYHEKISFKSFLLIIVLKSSLDMKEERFAAIVDPELLAWSDKTTVVGLSDLHWFMERLGIVQIAEYFQRRDIDENSDLLSIPIDDEGKELKSELTKRWQSLFPVRATRMFIHYSMQSIKTDEEFKMLQDLWRPRIVPILPYITRLLYQLQSYHDPDNWKGLPTVVQSFVKYSTIERFWEAGASNKSKDEFIDEHMKAMQTLRDFADSVGHIIRYTREYTLLVLSAISSLGSVFYLLDESPDLLLNSIAIFKPGSNEISPGVSTHGWKHIMNIAIRPILKGCPKDCLGKFMPAFLPKLFEILDLLLCQKWSSHMNDMDMNPVPTDDDQMTEEILEENLLRQLTTVVVRIVIDCVGQGNANPNSAKSRLNNHQMEMRKIIFNDLNTLAPFLKLLNHLISFKDTKCSFNSILVMKCCLTSVLNQNNTVDEYFTFEVMKNLLLNVLCNSAFKDSFHEALYAFTVIFLTLCKEYPSARAFLFEISNGYNIDELYRNLRSVDEYKTQRALMIDFIDWVKSTSGKEDGNVDHAGDERKRQEKREAILKKANERLIKKNKENGDMLDDPNIEDGAVGNLFDDN

SEQ ID NO: 192 - protein, 499 aa, Saccharomyces cerevisiae
  misc_feature (0)...(0): Polypeptide Accession Number YDR348C
MENRNSSTSSRPFSVNNPFRNATVDSSINQYKNDSQFQEWAKNQSRTNSFDMPQLNTRTSSQLSFPNIPEDEPQRNADQQGAFYSGLESFSSGSLSPPSRPLSSKNPFLDDVSSATDFRRSPPPVSRNKNHPTAKEEKEQLRQRYLEESDVSTVGNTRENTDLPPSYEEITSTNGSRRAYPKEKVSRPSSHREHSNSGTYISRRSSSHHHREASSSSTPSKKGKRKSKVIVPKNVDTIDKLDVTGLFGGSFHHDGPFDAVTPHRNKNNKAAPVLAFPVDGPNSTIGGASTKKSALDEVFGRDDTDDSDIYQYSSQTLRRGGDTQDAIKANVGNVQQMDAKNKTELVHGPVTAGLGSSTFLDGAPASSAAIRNDIKAHSYHNRNGGLQRNKSLSQRLGLGGSGDSNAPMTGVRRNLSLSRDNYDVGHSNEGVRRSKTVNSPNRTHKSNYTTDFDGQDDHNEDEEDVYLGVRYNEPNMKKKSTGSKLLSRVKSLKVGRKSQ

SEQ ID NO: 193 - protein, 122 aa, Saccharomyces cerevisiae
  misc_feature (0)...(0): Polypeptide Accession Number YDR357C
MQDNSSHSRESASAGDDPLGIDKLTVDYDYLLYKMRDYVQSIQLDTTELCKKQNEVMVNGIIENTIDKNIAKFKELLEKCDTLENHYEMLNQLAIITDTFKERIAEAVNNYNSLKKGASKSK

SEQ ID NO: 194 - protein, 345 aa, Saccharomyces cerevisiae
  misc_feature (0)...(0): Polypeptide Accession Number YDR372C
MSTLQRRRVNRADSGDTSSIHSSANNTKGDKIANIAVDGDDDNGTNKKIAYDPEESKLRDNINIPTLTLMEEVLLMGLRDREGYLSFWNDSISYALRGCIIIELALRGKIRILDDSARKRFDLSERLIEVIDSSKTGEVLLDETLQLMKNDEPLSISNWIDLLSGETWNLLKINYQLKQVRERLAKGLVDKGVLRTEMKNFFLFDMATHPIADASCKEAIKRRVLSVLVSRNMELSYNEYFPETTSFKIIRTLALICGSYGANVLENVLTTLEYEKRDKAISRAEEIMAQFSQYPFDLEKETELGVSVNLNKEVKEEIENNPGHDLQLEVIAGVFEVFSRMDMLL

SEQ ID NO: 195 - protein, 493 aa, Saccharomyces cerevisiae
  misc_feature (0)...(0): Polypeptide Accession Number YDR376W
MSFVQIRHISSQINRKTVSIVGSGPSGFYTAYHLLKKSPIPLNVTIWEKLPVPFGLSRYGVAPDHPEVKNCEETFTTCAEEFSSPTNQKHKFSFVGGITIGKEILLKELLDNQDAVILSYGCTGDRKLNIPGELGTKGVFSSREFVNWYNGHPDFAKDKRFTDFDWSKVSKVGIIGNGNVALDITRVLISNQIDEIWENTDISSLALNLLRRAPVKDVKLIARRDFVHSKFTNKELRELWELEKYGIRGRIDPKFFQKEMFDPSKYDRAFNRRVEMCSEYLKPFNERSKKNYKKAPPPSSGYDKFWELDYLKTPLKINRDDFGAINSLSLCNNRLNEDNSLQPLKDVNNIMTYKVDLLITSLGYAGVPMPEFSKLSIGFDKDHIANKQGRVLTSSGEIFPHLYASGWIRKGSQGVIASTMQDAFEVGDRVIQDLVVSGALSLENSIDLSNIKHTTWKDWERINKKELLRGKKEHKTRSKFLTFEELWNGVEGI

SEQ ID NO: 196 - protein, 226 aa, Saccharomyces cerevisiae
  misc_feature (0)...(0): Polypeptide Accession Number YDR381W
MSANLDKSLDEIIGSNKAGSNRARVGGTRGNGPRRVGKQVGSQRRSLPNRRGPIRKNTRAPPNAVARVAKLLDTTREVKVNVEGLPRDIKQDAVREFFASQVGGVQRVLLSYNERGQSTGMANITFKNGELARRAVERFNGSPIDGGRSRLRLNLIVDPNQRPVKSLADRIKAMPQKGGNAPRPVKRGPNRKAAMAKSQNKPKREKPAKKSLEDLDKEMADYFEKK

SEQ ID NO: 197 - protein, 110 aa, Saccharomyces cerevisiae
  misc_feature (0)...(0): Polypeptide Accession Number YDR382W
MKYLAAYLLLVQGGNAAPSAADIKAVVESVGAEVDEARINELLSSLEGKGSLEEIIAEGQKKFATVPTGGASSAAAGAAGAAAGGDAAEEEKEEEAKEESDDDMGFGLFD

SEQ ID NO: 198 - protein, 252 aa, Saccharomyces cerevisiae
  misc_feature (0)...(0): Polypeptide Accession Number YDR383C
MCTETKATIDCRNKMTDTYNSISNFIENELTALLSSDDYLMDDLAGELPNEVCRLLKAQVIEKRKDAMSRGKQDLLSKEIYDNESELRASQSQQIMELVGDIPKYSLGSELRNRVEGEPQSTSIERLIEDVLKLPQMEVADEEEVEVENDLKVLSEYSNLRKDLILKCQALQIGESKLSDILSQTNSINSLTTSIKEASEDDDISEYFATYNGKLVVALEEMKLLLEEAVKTFGNSPEKREKIKKILSELKK

SEQ ID NO: 199 - protein, 632 aa, Saccharomyces cerevisiae
  misc_feature (0)...(0): Polypeptide Accession Number YDR386W
MELSSNLKDLYIEWLQELVDGLTPKQEQLKIAYEKAKRNLQNAEGSFYYPTDLKKVKGIGNTIIKRLDTKLRNYCKIHHISPVEAPSLTQTSSTRPPKRTTTALRSIVNSCENDKNEAPEEKGTKKRKTRKYIPKKRSGGYAILLSLLELNAIPRGVSKEQIIEVAGKYSDHCMTPNFSTKEFYGAWSSIAALKKHSLVLEEGRPKRYSLTEEGVELTKSLKTADGISFPKENEEPNEYSVTRNESSEFTANLTDLRGEYGKEEEPCDINNTSFMLDITFQDLSTPQRLQNNVFKNDRLNSQTNISSHKLEEVSDDQTVPDSALKAKSTIKRRRYNGVSYELWCSGDFEVFPIIDHREIKSQSDREFFSRAFERKGMKSEIRQLALGDIIWVAKNKNTGLQCVLNTIVERKRLDDLALSIRDNRFMEQKNRLEKSGCEHKYYLIEETMSGNIGNMNEALKTALWVILVYYKFSMIRTCNSDETVEKIHALHTVISHHYSQKDLIVIFPSDLKSKDDYKKVLLQFRREFERKGGIECCHNLECFQELMGKGDLKTVGELTIHVLMLVKGISLEKAVAIQEIFPTLNKILMAYKTCSSEEEAKLLMFNVLGDAPGAKKITKSLSEKIYDAFGKL

SEQ ID NO: 200 - protein, 482 aa, Saccharomyces cerevisiae
  misc_feature (0)...(0): Polypeptide Accession Number YDR388W
MSFKGFTKAVSRAPQSFRQKFKMGEQTEDPVYEDAERRFQELEQETKKLSEESKRYSTAVNGMLTHQIGFAKSMEEIFKPISGKMSDPNATIPEDNPQGIEASEQYRAIVAELQETLKPDLALVEEKIVTPCQELLKIITYIRKMATKRNHKKLDLDRHLNTYNKHEKKKEPTAKDEERLYKAQAQVEVAQQEYDYYNDLLKTQLPILFSLEAEFVKPLFVSFYFMQLNIFYTLYNRLQDMKIPYFDLNSDIVESYIAKKGNVEEQTDALTITHFKLGYSKAKLEMTRRKYGVATAEGSPVSGASSGVGYGAGYDPATATSPTPTGYGYGAAAPSYAAQPAAQYGTAAAVGTAAAVGTAAGAAAGAVPGTYPQYAAAQSPPLTGLGFQQSPQQQQGPPPAYSNPLTSPVAGTPAAAVAAAPGVETVTALYDYQAQAAGDLSFPAGAVIEIVQRTPDVNEWWTGRYNGQQGVFPGNYVQLNKN

SEQ ID NO: 201 - protein, 428 aa, Saccharomyces cerevisiae
  misc_feature (0)...(0): Polypeptide Accession Number YDR394W
MEELGIVTPVEKAVEEKPAVKSYASLLAQLNGTVNNNSALSNVNSDIYFKLKKLEKEYELLTLQEDYIKDEQRHLKRELKRAQEEVKRIQSVPLVIGQFLEPIDQNTGIVSSTTGMSYVVRILSTLDRELLKPSMSVALHRHSNALVDILPPDSDSSISVMGENEKPDVTYADVGGLDMQKQEIREAVELPLVQADLYEQIGIDPPRGVLLYGPPGTGKTMLVKAVANSTKAAFIRVNGSEFVHKYLGEGPRMVRDVFRLARENAPSIIFIDEVDSIATKRFDAQTGSDREVQRILIELLTQMDGFDQSTNVKVIMATNRADTLDPALLRPGRLDRKIEFPSLRDRRERRLIFGTIASKMSLAPEADLDSLIIRNDSLSGAVIAAIMQEAGLRAVRKNRYVILQSDLEEAYATQVKTDNTVDKFDFYK

SEQ ID NO: 202 - protein, 643 aa, Saccharomyces cerevisiae
  misc_feature (0)...(0): Polypeptide Accession Number YDR398W
MDSPVLQSAYDPSGQYLCYVTVALDKQRVGVQPTQRATSSGVDTVWNENFLYLEDSKLKVTCLKWVNLASSDTVAIILGMNNGEIWLYSVLANEVTYKFTTGNSYEIKDIDLMGNQLWCIDSSDAFYQFDLLQFKLLQHFRINNCVQLNKLTIVPAGDSVAQLLVASHSISLIDIEEKKVVMTFPGHVSPVSTLQVITNEFFISGAEGDRFLNVYDIHSGMTKCVLVAESDIKELSHSGQADSIAVTTEDGSLEIFVDPLVSSSTKKRGNKSKKSSKKIQIVSKDGRKVPIYNAFINKDLLNVSWLQNATMPYFKNLQWREIPNEYTVEISLNWNNKNKSADRDLHGKDLASATNYVEGNARVTSGDNFKHVDDAIKSWERELTSLEQEQAKPPQANELLTETFGDKLESSTVARISGKKTNLKGSNLKTATTTGTVTVILSQALQSNDHSLLETVLNNRDERVIRDTIFRLKPALAVILLERLAERIARQTHRQGPLNVWVKWCLIIHGGYLVSIPNLMSTLSSLHSTLKRRSDLLPRLLALDARLDCTINKFKTLNYEAGDIHSSEPVVEEDEDDVEYNEELDDAGLIEDGEESYGSEEEEEGDSDNEEEQKHTSSKQDGRLETEQSDGEEEAGYSDVEME

SEQ ID NO: 203 - protein, 378 aa, Saccharomyces cerevisiae
  misc_feature (0)...(0): Polypeptide Accession Number YDR400W
MESADFFTSRNLLKQIISLICKVGEGLDSNNQRLFEEKMTVSKIPIWLDCDPGHDDAIAILLGCFHPAFNLLGISTCFGNAPPENTDYNARSLLTAMGKAQAIPVYKGAQRPWKREPHYAPDIHGISGLDGTSLLPKPTFEARTDKTYIEAIEEAILANNGEISFVSTGALTTLATVFRCKPYLKKSVKYISIMGGGLHGLGNCNPNLSAEFNVWIDPDAANYIFRDPDVKDKCIVVPLNLTHKAIATYKVNEMIYNEKNNSKLRELFLELFQFFAHTYKDMQGFESGPPIHDPVALMPLLEFYGWDPSSAVGFRYKRMDISCIDDVFNENSGKIIIEKEYPNDSDVGTIIGLDLNIQYFWDQIFEALNRADKMSTIG

SEQ ID NO: 204 - protein, 214 aa, Saccharomyces cerevisiae
  misc_feature (0)...(0): Polypeptide Accession Number YDR408C
MARIVVLISGSGSNLQALIDAQKQGQLGEDAHIVSVISSSKKAYGLTRAADNNIPTKVCSLYPYTKGIAKEDKAARAKARSQFENDLAKLVLEEKPDVIICAGWLLILGSTFLSQLQSVPILNLHPALPGCFDGTTHAIEMAWRKCQDENKPLTAGCMVHYVIEEVDKGEPLVVKKLEIIPGEETLEQYEQRVHDAEHIAIVEATYKVLQQLHK

SEQ ID NO: 205 - protein, 235 aa, Saccharomyces cerevisiae
  misc_feature (0)...(0): Polypeptide Accession Number YDR412W
MAVHTNRQILTRGKNYATKQSKKFGTDEVTFDKDSRLDYLTGFHKRKLQRQKKAQEFIKEQERLRKIEERQKIRQERKEVMEEQLKTFKESLNLEAEIEDAKNDKTEDLQVESDESWHGFDSDKDDGDNDNNESSVKPILKKGAITEIYDDSTTVELETLEPNDNFEYLAQLNNVKLEKAEKVLKQSINRATKYAKFLGVDEKQKKKPRVKKFRYLTKNERRINQRKANDNKRRR

SEQ ID NO: 206 - protein, 859 aa, Saccharomyces cerevisiae
  misc_feature (0)...(0): Polypeptide Accession Number YDR416W
MSAYIAMKGVITNVDENIRNDEDVAFEYEIQKTPQNILTWKRYIEYWKEEGRTDKQIRWLYERFCSQFVTDTSIWEDYIRWESTKEVVETSRIFWLFQRCLKSCVRDCDRICLSYLELAIEQYDLAMIRHALASSLMKMEREMHRKVWDPVIKFVEEKVLPLTQLDSTQEDEEESTDEAELINVLLVKGFTKGGFISEEISENGSRGDIWSSHILERYLKVAPQQKRNESLATLALTRDNITIKSVYEKYLPQDENSGKYLPSSELPFELNFNYLASLEKLGLDNQYEEFMRQMNGIYPDKWLFLILSLAKYYISRGRLDSCGDLLKKSLQQTLRYSDFDRIYNFYLLFEQECSQFILGKLKENDSKFFNQKDWTEKLQAHMATFESLINLYDIYLNDVALRQDSNLVETWMKRVSLQKSAAEKCNVYSEAILKIDPRKVGTPGSFGRLWCSYGDLYWRSNAISTARELWTQSLKVPYPYIEDLEEIYLNWADRELDKEGVERAFSILEDALHVPTNPEILLEKYKNGHRKIPAQTVLFNSLRIWSKYIDYLEAYCPKDANSSDKIFNKTKMAYNTVIDLRLITPAMAENFALFLQNHYEVMESFQVYEKTIPLFPPEIQYELWIEYLEVATSHQLSSLSPEHIRFLFEKALKNLCSNGIDCKTIFIAYSVFEERISGLISKSIEILRRGAVIGTVSVSTHLESRLQLWRMCISKAESTLGPSVTRELYQECIQILPNSKAVEFVIKFSDFESSIGETIRAREILAYGAKLLPPSRNTELWDSFEIFELKHGDKETYKDMLKMKKVLESNMLIDSASVSHEEGNINFVAAATSHAPNSHTLTQSTSSYSINPDEIELDI

SEQ ID NO: 207 - protein, 274 aa, Saccharomyces cerevisiae
  misc_feature (0)...(0): Polypeptide Accession Number YDR429C
MSEVAPEEIIENADGSRSIITYKIEDGVKYKITQKVKEVKVLEKVHKSVAERKNWHKYGSEKGSPAGPSAVTARLGEEVELRLSRNWKQAEEERIQKEKASLTKTGLQCRLCGNDHMTMNCPFKTILSELSALEDPATNEGGVEAASEEKAGQVGGAGSIPGQYVPPSRRAGARDPSSDAYRDSRERDDMCTLKIMQVNENADENSLREELLFPFAPIPRVSVVRNKETGKSRGLAFVTFSSEEVAEQALRFLDGRGYMNLILRVEWSKPKVKE

SEQ ID NO: 208 - protein, 347 aa, Saccharomyces cerevisiae
  misc_feature (0)...(0): Polypeptide Accession Number YDR439W
MTTLLQLLSNYYKAKLDSERIYNEYVQSQYEFASLDKLNNNKGDPKKVVDETLFLQRQIAQLNKQLQLSFQENEKLLSVQKNQKALYQSKLSSKDAFIDDLKLKLKVEQISVDKHNKERTPSTGRDEQQRNSKAAHTSKPTIHLLSPIVNRDKPNNQTNDRGGNDPDSPTSQRRSRGLRSLLSSGKNTIFDSISKNLDDEINENAHIRNDTTSSKIAGKSPSRLSALQKSPELRKERNNMILKEHILRSKDDQNITSSRKLDNIELSSIGDSTAMTSRSSTVNANDILGNEENDGITKLKRVNKLTSSPVKRDCSTNKKRKLTKQRIATLPNSDEELSNNLNVDEFV

SEQ ID NO: 209 - protein, 434 aa, Saccharomyces cerevisiae
  misc_feature (0)...(0): Polypeptide Accession Number YDR448W
MSNKFHCDVCSADCTNRVRVSCAICPEYDLCVPCFSQGSYTGKHRPYHDYRIIETNSYPILCPDWGADEELQLIKGAQTLGLGNWQDIADHIGSRGKEEVKEHYLKYYLESKYYPIPDITQNIHVPQDEFLEQRRHRIESFRERPLEPPRKPMASVPSCHEVQGFMPGRLEFETEFENEAEGPVKDMVFEPDDQPLDIELKFAILDIYNSRLTTRAEKKRLLFENHLMDYRKLQAIDKKRSKEAKELYNRIKPFARVMTAQDFEEFSKDILEELHCRARIQQLQEWRSNGLTTLEAGLKYERDKQARISSFEKFGASTAASLSEGNSRYRSNSAHRSNAEYSQNYSENGGRKKNMTISDIQHAPDYALLSNDEQQLCIQLKILPKPYLVLKEVMFRELLKTGGNLSKSACRELLNIDPIKANRIYDFFQSQNWM

SEQ ID NO: 210 - protein, 175 aa, Saccharomyces cerevisiae
  misc_feature (0)...(0): Polypeptide Accession Number YDR469W
MNESENSPQHNEVTVPMVEDTSSNADIPMEQIQREDNKNYDKHDNECFDMNGNHNNNSDNLQFDSVPSSATKDLKNIKSVTNQNVKIEESSSTNSVIEESSEPKISKLENVNLAATVGGSQTRKYLNTNVTPHLLAGMRLIAVQQPEDPLRVLGEYLIEQSNILKSGEKESNASK

SEQ ID NO: 211 - protein, 283 aa, Saccharomyces cerevisiae
  misc_feature (0)...(0): Polypeptide Accession Number YDR472W
MSQRIIQPSASDQQFPGKSDGYEYTVGPKQAITSEASTTYIPSRIYSESLLFKRQEASLSAMAFLFQEMISQLHRTCKTAGDFETKLSDYGHNIGIRLLELLNFRASVSPSSLPRASAFLSQNESSSKLSNASNSPGMLANSSTATSASANERLQEKQTESLSNYITKMRRRDLKILDILQFIHGTLWSYLFNHVSDDLVKSSERDNEYMIVDNFPTLTQFIPGENVSCEYFVCGIIKGFLFNAGFPCGVTAHRMPQGGHSQRTVYLIQFDRQVLDREGLRFG

SEQ ID NO: 212 - protein, 633 aa, Saccharomyces cerevisiae
  misc_feature (0)...(0): Polypeptide Accession Number YDR477W
MSSNNNTNTAPANANSSHHHHHHHHHHHHHGHGGSNSTLNNPKSSLADGAHIGNYQIVKTLGEGSFGKVKLAYHTTTGQKVALKIINKKVLAKSDMQGRIEREISYLRLLRHPHIIKLYDVIKSKDEIIMVIEYAGNELFDYIVQRDKMSEQEARRFFQQIISAVEYCHRHKIVHRDLKPENLLLDEHLNVKIADFGLSNIMTDGNFLKTSCGSPNYAAPEVISGKLYAGPEVDVWSCGVILYVMLCRRLPFDDESIPVLFKNISNGVYTLPKFLSPGAAGLIKRMLIVNPLNRISIHEIMQDDWFKVDLPEYLLPPDLKPHPEEENENNDSKKDGSSPDNDEIDDNLVNILSSTMGYEKDEIYESLESSEDTPAFNEIRDAYMLIKENKSLIKDMKANKSVSDELDTFLSQSPPTFQQQSKSHQKSQVDHETAKQHARRMASAITQQRTYHQSPFMDQYKEEDSTVSILPTSLPQIHRANMLAQGSPAASKISPLVTKKSKTRWHFGIRSRSYPLDVMGEIYIALKNLGAEWAKPSEEDLWTIKLRWKYDIGNKTNTNEKIPDLMKMVIQLFQIETNNYLVDFKFDGWESSYGDDTTVSNISEDEMSTFSAYPFLHLTTKLIMELAVNSQSN

SEQ ID NO: 213 - protein, 323 aa, Saccharomyces cerevisiae
  misc_feature (0)...(0): Polypeptide Accession Number YDR480W
MNKEEQEDPQQEQISTVQENDPRNLQQLGMLLVSPGLDEDRLSEKMISKIKKSRDIEKNQKLLISRLSQKEEDHSGKPPTITTSPAEKTVPFKSLNHSLKRKRVPPALNFSDIQASSHLHGSKSAPPNITRFPQHKNSLRVRYMGRMAPTNQDYHPSVANSYMTATYPYPYTGLPPVPCYPYSSTPTQTHAYEGYYSPMYPGPLYNNGIIPADYHAKRKKLAGRSPHLEDLTSRKRTFVSKHHNGDPIISKTDEDIECSVTKNSLSEGASLNDDADDDNDKERIIIGEISLYDDVFKFEVRDDKNDYMKACETIWTEWHNLKK

SEQ ID NO: 214 - protein, 135 aa, Saccharomyces cerevisiae
  misc_feature (0)...(0): Polypeptide Accession Number YDR482C
MSYNGIGLKSAKGSSTSGHVQRSLASNNRRRPQGSQQQRQQRQNAIKKASHDKASRPLAVQKQIETHMEKREIEVQVSELRDRLEEEETLSEEQIDKKCEALRAKLTNEWQEQQRMSSLYTPRKARLTEEQHRHE

SEQ ID NO: 215 - protein, 294 aa, Saccharomyces cerevisiae
  misc_feature (0)...(0): Polypeptide Accession Number YDR489W
MDINIDDILAELDKETTAVDSTKITQGSSSTTHRDANTIVGSSLDLNDKTQIYVSPQQDFSDLMKSWKNERCSPELLPYPHQLMKRLLNRISMQSQLIENISMGFLDMQNASNANPPMPNESKLPLLCMETELERLKFVIRSYIRCRLSKIDKFSLYLRQLNEDENSLISLTDLLSKDEIKYHDTHSLIWLKLVNDSILKYMPEELQAINDTEGSVNMIDEPDWNKFVFIHVNGPPDGKWNEDPLLQENEFGKPCYTVTIPDLKEEVELTIGSIYVMRYEVIRDLLRDDKVALI

SEQ ID NO: 216 - protein, 766 aa, Saccharomyces cerevisiae
  misc_feature (0)...(0): Polypeptide Accession Number YDR490C
MGNRSLTEADHALLSKPLVPTSAEHTQTQEYPRPFVDGSNSQSGSELQASPQGQFGEKALTSTNRFIPLANDDPGMQHEMGLDPSMRRRREEWAERGAAKIVKDVVDPATGELTKHVVKMGIKDFKFGEQLGDGSYSSVVLATARDSGKKYAVKVLSKEYLIRQKKVKYVTVEKLALQKLNGTKGIFKLFFTFQDEASLYFLLEYAPHGDFLGLIKKYGSLNETCARYYASQIIDAVDSLHNIGIIHRDIKPENILLDKNMKVKLTDFGTAKILPEEPSNTADGKPYFDLYAKSKSFVGTAEYVSPELLNDNYTDSRCDIWAFGCILYQMLAGKPPFKAANEYLTFQKVMKIQYAFTAGFPQIVKDLVKKLLVRDPNDRLTIKQIKAHLFFHEVNFEDGSVWDDNPPEIQPYKINAEAMKPLQKVSESDTTVKMANLQLAGNGHADTPLQAPAATSQEHSVISMTAATAAFNKDYTSQPKLGSKSSTSVRSASNNTDREVIQKKVSKNRASVSSPSISTTSRGKDNRSRSSDAFWSRYLQNMDERVLLMKEVALSTRNLEDSPVGLENVALDYKNPLDIEPPTDSAGKFYKKMFLITNLGRALVFVKRRSLSMWEEQEFELQFELELNDVEKIRFISDQVLEIDGSRTIFIGCKERAVLMKLWKLIHNGMTAKPKVVSPKSDHKMFDKFILQKRQNTKKKNQAPPVPQSNRLINGLPDRCILKTPEEGALHTKRPTSLQTRSSSNYSKLLARSTQMRKNMTRTDEK

SEQ ID NO: 217 - protein, 274 aa, Saccharomyces cerevisiae
  misc_feature (0)...(0): Polypeptide Accession Number YDR503C
MISVMADEKHKEYFKLYYFQYMIIGLCTILFLYSEISLVPRGQNIEFSLDDPSISKRYVPNELVGPLECLILSVGLSNMVVFWTCMFDKDLLKKNRVKRLRERPDGISNDFHFMHTSILCLMLIISINAALTGALKLIIGNLRPDFVDRCIPDLQKMSDSDSLVFGLDICKQTNKWILYEGLKSTPSGHSSFIVSTMGFTYLWQRVFTTRNTRSCIWCPLLALVVMVSRVIDHRHHWYDVVSGAVLAFLVIYCCWKWTFTNLAKRDILPSPVSV

SEQ ID NO: 218 - protein, 663 aa, Saccharomyces cerevisiae
  misc_feature (0)...(0): Polypeptide Accession Number YDR508C
MTLGNRRHGRNNEGSSNMNMNRNDLDDVSHYEMKEIQPKEKQIGSIEPENEVEYFEKTVEKTIENMEYEGEHHASYLRRFIDSFRRAEGSHANSPDSSNSNGTTPISTKDSSSQLDNELNRKSSYITVDGIKQSPQEQEQKQENLKKSIKPRHTVMMSLGTGIGTGLLVGNSKVLNNAGPGGLIIGYAIMGSCVYCIIQACGELAVIYSDLIGGFNTYPLFLVDPALGFSVAWLFCLQWLCVCPLELVTASMTIKYWTTSVNPDVFVVIFYVLIVVINVFGAKGYAEADFFFNCCKILMIVGFFILAIIIDCGGAGTDGYIGSKYWRDPGAFRGDTPIQRFKGVVATFVTAAFAFGMSEQLAMTASEQSNPRKAIPSAAKKMIYRILFVFLASLTLVGFLVPYTSDQLLGAAGSATKASPYVIAVSSHGVRVVPHFINAVILLSVLSVANGAFYTSSRILMSLAKQGNAPKCFDYIDREGRPAAAMLVSALFGVIAFCASSKKEEDVFTWLLAISGLSQLFTWITICLSHIRFRRAMKVQGRSLGEVGYKSQVGVWGSAYAVLMMVLALIAQFWVAIAPIGGGGKLSAQSFFENYLAMPIWIALYIFYKVWKKDWSLFIPADKVDLVSHRNIFDEELLKQEDEEYKERLRNGPYWKRVLDFWC

SEQ ID NO: 219 - protein, 101 aa, Saccharomyces cerevisiae
  misc_feature (0)...(0): Polypeptide Accession Number YDR510W
MSDSEVNQEAKPEVKPEVKPETHINLKVSDGSSEIFFKIKKTTPLRRLMEAFAKRQGKEMDSLRFLYDGIRIQADQTPEDLDMEDNDIIEAHREQIGGATY

SEQ ID NO: 220 - protein, 447 aa, Saccharomyces cerevisiae
  misc_feature (0)...(0): Polypeptide Accession Number YDR515W
MSSQNLNDNPKNTSSAAEDKKKQTSSLKLAPIPTTSPWKSSSPDSNTVIPVEELRDISKTAKPSKNGSGSIKLTSNTKWTPITPSVIISGSKDTNSKSGKNSKNSKTNKKMKKRGKYNNDINKKDFNGQTNSTSEISNVSNLESKPLDANAKVNIHSSSGATANGNIKRITNNNNSTNGRQSRNYQNRNGKTRYNNNSRHSQAANNAISFPNNYQARPEYIPNASHWLNNNSRNSYKQLSYFRQQQYYNNINYQQQLQTPYYYSMEPIFKSIESIKNQIEFYFSEENLKTDEFLRSKFKKANDGFIPMSLIGKFYRMVNLSLGGDPNLILASMREVLQHKETNHLEIALGSIEGAQKNMADDFNPLENYFIRRENWAEYAMESNFDENDDETEKYNIEKLLGPNDLDNYSYMGYPNFFPSNENGKKSQSYDQGEISRQFEQNLQIND

SEQ ID NO: 221 - protein, 281 aa, Saccharomyces cerevisiae [sequence omitted]

SEQ ID NO: 222 - protein, 551 aa, Saccharomyces cerevisiae
  misc_feature (0)...(0): Polypeptide Accession Number YEL015W
MSQFVGFGVQVELKDGKLIQGKIAKATSKGLTLNDVQFGDGGKSQAFKVRASRLKDLKVLTVASQSGKRKQQRQQQQQNDYNQNRGEHIDWQDDDVSKIKQQEDFDFQRNLGMFNKKDVFAQLKQNDDILPENRLQGHNRKQTQLQQNNYQNDELVIPDAKKDSWNKISSRNEQSTHQSQPQQDAQDDLVLEDDEHEYDVDDIDDPKYLPITQSLNITHLIHSATNSPSINDKTKGTVINDKDQVLAKLGQMIISQSRSNSTSLPAANKQTTIRSKNTKQNIPMATPVQLLEMESITSEFFSINSAGLLENFAVNASFFLKQKLGGRARLRLQNSNPEPLVVILASDSNRSGAKALALGRHLCQTGHIRVITLFTCSQNELQDSMVKKQTDIYKKCGGKIVNSVSSLESAMETLNSPVEIVIDAMQGYDCTLSDLAGTSEVIESRIKSMISWCNKQRGSTKVWSLDIPNGFDAGSGMPDIFFSDRIEATGIICSGWPLIAINNLIANLPSLEDAVLIDIGIPQGAYSQRTSLRKFQNCDLFVTDGSLLLDL

SEQ ID NO: 223 - protein, 682 aa, Saccharomyces cerevisiae
  misc_feature (0)...(0): Polypeptide Accession Number YEL023C
MDSFNYIHGKYKKNGTGGDRSINPSSHSSSGKNIILCFDGTRENFGPQPFTNILKLYNLLENGDSSEQICYYQPGIGSVGFDAVVDVRRRLTISHLQNLLDSMFAFSLDNHICSAYLFLMKYFEPGDRIYMFGFSRGAFIARVLAGMIERVGLLSKGLEEMVKMAWQIYEKWEYDSQPNELQYTSTLAEEFKKTFSRDYEVKIHFQGLFDSVNSVGILRDRLFPCTQRSNIVEHVRHCVSLDERRGKFKQLCFTPMPYIPKLFSLTYCNHITDQCSPVPTSNALMRDLTPENPLIKYTLKSGAHSISNPSPLIPDNPGRLLSSKSEETTELLLDLNSFLEGNSYARDTECSTRGIEAIFQLQSIQGSGTSSRMTMTPDLIEKWFPGDHSDVGGGWAPDCETEENLSNLTLRWILAEAIKFGVKFKPGAIHDFATKHTSIGSLFADTHDYLSFNSPKKCSLLGVSDNEDGAREDKSGRNERMEDCLKNIKETRLSLKDEKEKVKDAFTLKCGHANKFMRLVWWVLELLPIGIRMENKEGKWQNFHTPNLGRSRYVPEYVSLHWSVYWRIKFDRRYRPDNMPEYVRQLFQDLEGIDLKSNKVSNKYDKQDNSNGSEINGGFFDNEEGQELHMGQKASYFATTYNSRLFDSKYSQLKKKFMDWDSNSWTDIPDDLKIYLQQDESL

SEQ ID NO: 224 - protein, 495 aa, Saccharomyces cerevisiae
  misc_feature (0)...(0): Polypeptide Accession Number YEL041W
MKTDRLLINASPETCTKGDAEMDTMDTIDRMTSVKVLAEGKVLSNFEEPGLMRCGYHDAKNWVRRLSSETIVGEDTSNLYPFYVDTAYDVRRLRKDLINAKVDLQVENLIIICNINDISTVFLMREVVEWILRNFHSITVYVQDIFKKSTQFAVGDLCKDSNCSKNRVKYWSKEFVKKHDSFFDLMITLGGDGTVLFASSIFTKDVPPIVPFALGSLGFLTNFEFQNFKETLKHILTDEVRINLRMRLQCKLYRRNKPEIDAATGRKICYIDFISEHHVLNEVTIDRGPAPCLSLLELYGNDSLMTKVQGDGLIVATPTGSTAYSLSAGGSLISPSVNAIAVTPICPHTLSFRPIILPDSMELKVRVDMNSRGTSWVNFDGKDRVELKQGDYVVITASPYSVPTIESSASEFFESISKNLNWNDREEQKPFAHILSPKNQEKYRLDSSKNGNDTISNPLESSCISSDAQDEERKSVTETETEIVVERTRQAHFAI

SEQ ID NO: 225 - protein, 733 aa, Saccharomyces cerevisiae
  misc_feature (0)...(0): Polypeptide Accession Number YEL053C
MEVDSILGSLSITDDFDQLVDVTSLFDELCSKLKPEAIVKDPRFDLFEGTHSLEVNNSKLDSSLIELTAEEIEFDVNVAYDPPLASVAAIADRLLRCVISWLNDYQTLPTTVLSCRYTESLLSSLVKGTTAGSSWCTGNILYDKVLGSCILGVCYLTKFVQKLLSAGIVFEEEDLNFNNMGFNTFDNLPGQDVVINSLTESLQILEAYSDDSLHLTMLKHILKIIICLVHLEDHLTDYSTKTSHLDELIENANSVNGIFPQLQLSPPKGAFSTYIQKHRSNQFPPRKITKLPTDYSGFITLANDVKTILLVDKAESALETYQFAKFFNKLEQRHVIARILFPLFFIRDDRTVLGKFSYTQFYLLHVKEFSAQTPSEFESSIGNELIQESSNMLLEWYQNCSQNTCRYRQGFNRQLILWDSLQAQFESVNSQVYCSWTYFMKLSSMIEFSLKGFDLDIYKPFEAYSMFWYVYYLSHHLETFLKDSQNDIESNINAIHSMNKKLKKLKAGEKKDQLRLKYRFAMDNEMEQLQATKQFLNYLLKEINITKSLCLIEVFQFAILKSFGLIDNKNSTPSKFSNERLIHNLRFKPFNSIGVPELPEYEVFQQTLKDFVIEEKGAAFDIKLERATNFIETEVRNVVSSIDEIMQGIKGGDNNGVLVTGTRLVQELSLEYYCKLKHTSKALSVNSKVIVNTLKKNIKNKDSHEYKVELVHTTEGWNYFPIQTLRIKQDRYK

SEQ ID NO: 226 - protein, 635 aa, Saccharomyces cerevisiae
  misc_feature (0)...(0): Polypeptide Accession Number YEL060C
MKLENTLFTLGALGSISAALVIPNLENAADHHELINKEDHHERPRKVEFTKDDDEEPSDSEDKEHGKFHKKGRKGQDKESPEFNGKRASGSHGSAHEGGKGMKPKHESSNDDDNDDKKKKPHHKGGCHENKVEEKKMKGKKVKGKKHHEKTLEKGRHHNRLAPLVSTAQFNPDAISKIIPNRYIIVFKRGAPQEEIDFHKENVQQAQLQSVENLSAEDAFFISTKDTSLSTSEAGGIQDSFNIDNLFSGYIGYFTQEIVDLIRQNPLVDFVERDSIVEATEFDTQNSAPWGLARISHRERLNLGSFNKYLYDDDAGRGVTSYVIDTGVNINHKDFEKRAIWGKTIPLNDEDLDGNGHGTHCAGTIASKHYGVAKNANVVAVKVLRSNGSGTMSDVVKGVEYAAKAHQKEAQEKKKGFKGSTANMSLGGGKSPALDLAVNAAVEVGIHFAVAAGNENQDACNTSPASADKAITVGASTLSDDRAYFSNWGKCVDVFAPGLNILSTYIGSDDATATLSGTSMASPHVAGLLTYFLSLQPGSDSEFFELGQDSLTPQQLKKKLIHYSTKDILFDIPEDTPNVLIYNGGGQDLSAFWNDTKKSHSSGFKQELNMDEFIGSKTDLIFDQVRDILDKLNII

SEQ ID NO: 227 - protein, 624 aa, Saccharomyces cerevisiae
  misc_feature (0)...(0): Polypeptide Accession Number YEL062W
MVRSSGQRQMLSYFQGFVPIHTIFYSVFHPTEGSKIKYEFPPNNLKNHGINFNTFKNYIIPKPILCHKLITFKYGTYRIVCYPVTINSPIYARNFFSFNFVFVFPYDCETSPYEPAITRLGKMFKVLEEQNQLLSKSERDPVFFDLKVLENSTTTPSTAGPSSTPNPSSNTTPTHPTSEKDTKDMRSSRYSDLIKDLGLPQSAFSIQDLLMRIFQDLNNYSECLIPIDEGNAVDIKIFPLLRPPTTCVSLEDVPLSSVNLKKIIDVNWDPTMMSIVPYIDGLNSIAKISKLSNSDPGLVIECIRHLIYYKCVTLSDIFQFSNIYAPSSLIRNFLTDPLMASDCQSYVTFPEVSKISNLPLNKSLGSGDQDSPSFSVRRKSKSSSIPSNPDSRTTSFSSTSRVSQNSSLNSSFSSIYKDWRQSQTSCSSSNIHVINNRNRFLPTRSCLFDLYRSLSQGQTLKTWYESKYMILKENNIDIRRFITFGLEKRIIYRCYSFPVMINAGSREPKEMTPIITKDLVNNDKLLEKRNHNHLLSATGSRNTAQSGNLKPERPSKVSFEMQRVSSLATGKSTMPKLSDEEEGILEESIRNAETFDKICVLLSKPKLEVESYLNELGEFKVINS

SEQ ID NO: 228 - protein, 110 aa, Saccharomyces cerevisiae
  misc_feature (0)...(0): Polypeptide Accession Number YEL068C
MKILALAVAFQGLALVCCTDTTDNYNNFTHNTSTFYRIADYDKRFWSVKLPPVNWTTCGNEDHPWITIHYDEIDKLVDDKLASWDKGPVPDREEFRNSILRQARCDRPHY

SEQ ID NO: 229 - protein, 181 aa, Saccharomyces cerevisiae
  misc_feature (0)...(0): Polypeptide Accession Number YER007C-A
MFKKFTREDVHSRSKVKSSIQRTLKAKLVKQYPKIEDVIDELIPKKSQIELIKCEDKIQLYSVDGEVLFFQKFDELIPSLKLVHKFPEAYPTVQVDRGAIKFVLSGANIMCPGLTSAGADLPPAPGYEKGTIVVINAENKENALAIGELMMGTEEIKSVNKGHSIELIHHLGDPLWNFSVE

SEQ ID NO: 230 - protein, 234 aa, Saccharomyces cerevisiae
  misc_feature (0)...(0): Polypeptide Accession Number YER010C
MSDLQKLQRFSTCDISDGLLNVYNIPTGGYFPNLTAISPPQNSSIVGTAYTVLFAPIDDPRPAVNYIDSVPPNSILVLALEPHLQSQFHPFIKITQAMYGGLMSTRAQYLKSNGTVVFGRIRDVDEHRTLNHPVFAYGVGSCAPKAVVKAVGTNVQLKILTSDGVTQTICPGDYIAGDNNGIVRIPVQETDISKLVTYIEKSIEVDLLVSEDIKNGIPAKQAQNDRRSVLKKYI

SEQ ID NO: 231 - protein, 344 aa, Saccharomyces cerevisiae
  misc_feature (0)...(0): Polypeptide Accession Number YER016W
MSAGIGESRTELLTWLNGLLNLNYKKIEECGTGAAYCQIMDSIYGDLPMNRVKFNATAEYEFQTNYKILQSCFSRHGIEKTVYVDKLIRCKFQDNLEFLQWLKKHWIRHKDESVYDPDARRKYRPIITNNSATKPRTVSNPTTAKRSSSTGTGSAMSGGLATRHSSLGINGSRKTSVTQGQLVAIQAELTKSQETIGSLNEEIEQYKGTVSTLEIEREFYFNKLRDIEILVHTTQDLINEGVYKFNDETITGHGNGNGGALLRFVKKVESILYATAEGFEMNDGEDELNDKNLGEHGTVPNQGGYANSNGEVNGNEGSNHDVIMQNDEGEVGVSNNLIIDEETF

SEQ ID NO: 232 - protein, 221 aa, Saccharomyces cerevisiae
  misc_feature (0)...(0): Polypeptide Accession Number YER018C
MASIDAFSDLERRMDGFQKDVAQVLARQQNHARQQLQQFQAEMRQLHNQHQHLIDELQRLATQRTALQQQIHAAQQATNTTREQWRSYHERESELSRRQSTLAAQSRELDSLLQQRGKECVQLRARWAAQSGNDAAEVALYERLLQLRVLPGASDVHDVRFVFGDDSRCWIEVAMHGDHVIGNSHPALDPKSRATLEHVLTVQGDLAAFLVVARDMLLASL

SEQ ID NO: 233 - protein, 88 aa, Saccharomyces cerevisiae
  misc_feature (0)...(0): Polypeptide Accession Number YER019C-A
MAASVPPGGQRILQKRRQAQSIKEKQAKQTPTSTRQAGYGGSSSSILKLYTDEANGFRVDSLVVLFLSVGFIFSVIALHLLTKFTHII

SEQ ID NO: 234 - protein, 523 aa, Saccharomyces cerevisiae
  misc_feature (0)...(0): Polypeptide Accession Number YER021W
MASTAVMMDVDSSGVNDLHHSEKKYAEEDQVQELLKVLNEISKTTLTLDPRYIWRSLKDLSSLRNQELLNAETLCFTVNVLYPDSSSFKKNLLKFITSNHKSSVPGSAELRNSYPASFYSVNTEKKTIEVTAEINCFMHLLVQLFLWDSKELEQLVEFNRKVVIPNLLCYYNLRSLNLINAKLWFYIYLSHETLARSSEEINSDNQNIILRSTMMKFLKIASLKHDNETKAMLINLILRDFLNNGEVDSASDFISKLEYPHTDVSSSLEARYFFYLSKINAIQLDYSTANEYIIAAIRKAPHNSKSLGFLQQSNKLHCCIQLLMGDIPELSFFHQSNMQKSLLPYYHLTKAVKLGDLKKFTSTITKYKQLLLKDDTYQLCVRLRSNVIKTGIRIISLTYKKISLRDICLKLNLDSEQTVEYMVSRAIRDGVIEAKINHEDGFIETTELLNIYDSEDPQQVFDERIKFANQLHDEYLVSMRYPEDKKTQQNEKSENGENDDDTLDGDLMDDMSDISDLDDLGFL

SEQ ID NO: 235 - protein, 286 aa, Saccharomyces cerevisiae
  misc_feature (0)...(0): Polypeptide Accession Number YER023W
MTYTLAILGCGVMGQALLSAIYNAPKAADETAAAFYPSKIITCNHDEPSAQQVTDLVETFDESPNGIKVESTYGHNVSAVEEASVVLLGTKPFLAEEVLNGVKSVIGGKLLISLAAGWTIDQLSQYTSTVCRVMTNTPAKYGYGCAVVSYSADVSKEQKPLVNELISQVGKYVELPEKNMDAATALVGSGPAFVLLMLESLMESGLKLGIPLQESKECAMKVLEGTVKMVEKSGAHPSVLKHQVCTPGGTTIAGLCVMEEKGVKSGIINGVEEAARVASQLGQKKK

SEQ ID NO: 236 - protein, 417 aa, Saccharomyces cerevisiae
  misc_feature (0)...(0): Polypeptide Accession Number YER027C
MAGDNPENKDASMLDVSDAASNTTINGKHSADSTNEASLAYTFSQMNVDNPNELEPQHPLRHKSSLIFNDDDDDEIPPYSNHAENGSGETFDSDDDIDASSSSSIDSNEGDIHDADMTGNTLQKMDYQPSQQPDSLQNQGFQQQQEQQQGTVEGKKGRAMMFPVDITWQQGGNKVYVTGSFTGWRKMIGLVPVPGQPGLMHVKLQLPPGTHRFRFIVDNELRFSDYLPTATDQMGNFVNYMEVSAPPDWGNEPQQHLAEKKANHVDDSKLSKRPMSARSRIALEIEKEPDDMGDGYTRFHDETPAKPNLEYTQDIPAVFTDPNVMEQYYLTLDQQQNNHQNMAWLTPPQLPPHLENVILNSYSNAQTDNTSGALPIPNHVILNHLATSSIKHNTLCVASIVRYKQKYVTQILYTPLQ

SEQ ID NO: 237 - protein, 143 aa, Saccharomyces cerevisiae
  misc_feature (0)...(0): Polypeptide Accession Number YER046W
MGKNHFLKDFSALPEDVLIENERGITLLGYPLFSPKILLPHVDPPQFQRLNTENGSLIALSKNTISNFIELYPIDLSTERTAGSSSSQMTKWFVLMDYKEKYDIDDQGWCYSWNFNNSRWKSKNGLVRRRVWVRLPTTSHGLD

SEQ ID NO: 238 - protein, 527 aa, Saccharomyces cerevisiae
  misc_feature (0)...(0): Polypeptide Accession Number YER052C
MPMDFQPTSSHSNWVVQKFGGTSVGKFPVQIVDDIVKHYSKPDGPNNNVAVVCSARSSYTKAEGTTSRLLKCCDLASQESEFQDIIEVIRQDHIDNADRFILNPALQAKLVDDTNKELELVKKYLNASKVLGEVSSRTVDLVMSCGEKLSCLFMTALCNDRGCKAKYVDLSHIVPSDFSASALDNSFYTFLVQALKEKLAPFVSAKERIVPVFTGFFGLVPTGLLNGVGRGYTDLCAALIAVAVNADELQVWKEVDGIFTADPRKVPEARLLDSVTPEEASELTYYGSEVIHPFTMEQVIRAKIPIRIKNVQNPLGNGTIIYPDNVAKKGESTPPHPPENLSSSFYEKRKRGATAITTKNDIFVINIHSNKKTLSHGFLAQIFTILDKYKLVVDLISTSEVHVSMALPIPDADSLKSLRQAEEKLRILGSVDITKKLSIVSLVGKHMKQYIGIAGTMFTTLAEEGINIEMISQGANEINISCVINESDSIKALQCIHAKLLSERTNTSNQFEHAIDERLEQLKRLGI

SEQ ID NO: 239 - protein, 420 aa, Saccharomyces cerevisiae
  misc_feature (0)...(0): Polypeptide Accession Number YER059W
MSIKGDSPSSTNASSSPKSTYSIQSDDKANLGSGNVDIRTDNSQQDSNNRRDIVVVTRVASEETLESQSSTSSMGIRPESSFNYEDASNQARVEMNNRVHGSNMNTINKYYPVRFPKNNERQLSDTNNLNEKVQGTHTVQSSTQEDKILDGDTSNSQVTPSLNIAEFPTDKLLKMLTALLTKIIKSNDRTAATNPSLTQEIENGRCLALSDNEKKYLSPVLGFRGKHVPQIGLDQYFQRIQKYCPTTNDVFLSLLVYFDRISKRCNSVTTTPKTNTAKHESPSNESSLDKANRGADKMSACNSNENNENDDSDDENTGVQRDSRAHPQMFVMDSHNIHRLIIAGITVSTKFLSDFFYSNSRYSRVGGISLQELNHLELQFLVLCDFELLISVNELQRYADLLYRFWNNAKAQSQALVTGM

SEQ ID NO: 240 - protein, 250 aa, Saccharomyces cerevisiae
  misc_feature (0)...(0): Polypeptide Accession Number YER062C
MGLTTKPLSLKVNAALFDVDGTIIISQPAIAAFWRDFGKDKPYFDAEHVIQVSHGWRTFDAIAKFAPDFANEEYVNKLEAEIPVKYGEKSIEVPGAVKLCNALNALPKEKWAVATSGTRDMAQKWFEHLGIRRPKYFITANDVKQGKPHPEPYLKGRNGLGYPINEQDPSKSKVVVFEDAPAGIAAGKAAGCKIIGIATTFDLDFLKEKGCDIIVKNHESIRVGGYNAETDEVEFIFDDYLYAKDDLLKW

SEQ ID NO: 241 - protein, 218 aa, Saccharomyces cerevisiae
  misc_feature (0)...(0): Polypeptide Accession Number YER063W
MADYSSLTVVQLKDLLTKRNLSVGGLKNELVQRLIKDDEESKGESEVSPQEQNQEQGSEPAAIEEPASQNITEKKEVSSEPKETNEPKEENKDVQKPSDGPSATASENEQAAASTAAPALSPEEIKAKALDLLNKKLHRANKFGQDQADIDSLQRQINRVEKFGVDLNSKLAEELGLVSRKNEPESGNNGKFKNRNKNANNRSRVSKNRRGNRSGYRR

SEQ ID NO: 242 - protein, 557 aa, Saccharomyces cerevisiae
  misc_feature (0)...(0): Polypeptide Accession Number YER065C
MPIPVGNTKNDFAALQAKLDADAAEIEKWWSDSRWSKTKRNYSARDIAVRRGTFPPIEYPSSVMARKLFKVLEKHHNEGTVSKTFGALDPVQISQMAKYLDTIYISGWQCSSTASTSNEPGPDLADYPMDTVPNKVEHLFKAQLFHDRKQLEARSKAKSQEELDEMGAPIDYLTPIVADADAGHGGLTAVFKLTKMFIERGAAGIHMEDQTSTNKKCGHMAGRCVIPVQEHVNRLVTIRMCADIMHSDLIVVARTDSEAATLISSTIDTRDHYFIVGATNPNIEPFAEVLNDAIMSGASGQELADIEQKWCRDAGLKLFHEAVIDEIERSALSNKQELIKKFTSKVGPLTETSHREAKKLAKEILGHEIFFDWELPRVREGLYRYRGGTQCSIMRARAFAPYADLVWMESNYPDFQQAKEFAEGVKEKFPDQWLAYNLSPSFNWPKAMSVDEQHTFIQRLGDLGYIWQFITLAGLHTNALAVHNFSRDFAKDGMKAYAQNVQQREMDDGVDVLKHQKWSGAEYIDGLLKLAQGGVSATAAMGTGVTEDQFKENGVKK

SEQ ID NO: 243 - protein, 210 aa, Saccharomyces cerevisiae
  misc_feature (0)...(0): Polypeptide Accession Number YER079W
MPDSSHSISSKDVASAISLYDQSIYTNNRSTNLDLDQRSMSPSNIASGEDRITRTNSGCSITSGASMIATKDGIQGINVKRDGIPKYSLNLLNSMVRKQYDHNNGTKSPTPKTSNMVDPKNKKKNKKKKNDKDDKYKVSHDQTEKFYKLNTTSNSNLTSDSTTSLSDQFYFQKSNADSAPLDNANYPLSDHSPSLNSMDNTTKHSSNVHT

SEQ ID NO: 244 - protein, 469 aa, Saccharomyces cerevisiae
  misc_feature (0)...(0): Polypeptide Accession Number YER081W
MTSIDINNLQNTFQQAMNMSGSPGAVCTSPTQSFMNTVPQRLNAVKHPKILKPFSTGDMKILLLENVNQTAITIFEEQGYQVEFYKSSLPEEELIEKIKDVHAIGIRSKTRLTSNVLQHAKNLVCIGCFCIGTNQVDLDYATSRGIAVFNSPFSNSRSVAELVIAEIISLARQLGDRSIELHTGTWNKVAARCWEVRGKTLGIIGYGHIGSQLSVLAEAMGLHVLYYDIVTIMALGTARQVSTLDELLNKSDFVTLHVPATPETEKMLSAPQFAAMKDGAYVINASRGTVVDIPSLIQAVKANKIAGAALDVYPHEPAKNGEGSFNDELNSWTSELVSLPNIILTPHIGGSTEEAQSSIGIEVATALSKYINEGNSVGSVNFPEVALKSLSYDQENTVRVLYIHQNVPGVLKTVNDILSNHNIEKQFSDSNGEIAYLMADISSVDQSDIKDIYEQLNQTSAKISIRLLY

SEQ ID NO: 245 - protein, 554 aa, Saccharomyces cerevisiae
  misc_feature (0)...(0): Polypeptide Accession Number YER082C
MGHKKNGHRRQIKERENQNKFERSTYTNNAKNNHTQTKDKKLRAGLKKIDEQYKKAVSSAAATDYLLPESNGYLEPENELEKTFKVQQSEIKSSVDVSTANKALDLSLKEFGPYHIKYAKNGTHLLITGRKGHVASMDWRKGQLRAELFLNETCHSATYLQNEQYFAVAQKKYTFIYDHEGTELHRLKQHIEARHLDFLPYHYLLVTAGETGWLKYHDVSTGQLVSELRTKAGPTMAMAQNPWNAVMHLGHSNGTVSLWSPSMPEPLVKLLSARGPVNSIAIDRSGYYMATTGADRSMKIWDIRNFKQLHSVESLPTPGTNVSISDTGLLALSRGPHVTLWKDALKLSGDSKPCFGSMGGNPHRNTPYMSHLFAGNKVENLGFVPFEDLLGVGHQTGITNLIVPGAGEANYDALELNPFETKKQRQEQEVRTLLNKLPADTITLDPNSIGSVDKRSSTIRLNAKDLAQTTMDANNKAKTNSDIPDVKPDVKGKNSGLRSFLRKKTQNVIDERKLRVQKQLDKEKNIRKRNHQIKQGLISEDHKDVIEEALSRFG

SEQ ID NO: 246 - protein, 125 aa, Saccharomyces cerevisiae
  misc_feature (0)...(0): Polypeptide Accession Number YER092W
MPSKDPESVIDKEIRKISARNDELIKQDGTLKREYTTLLRKVSSVITVLNSIDDADTGSAETELPRLISQATVEKVPELKWYNDQISLITEKLEDDEDIEVPEELMDAYTLYKETPLLYNDTHTP

SEQ ID NO: 247 - protein, 400 aa, Saccharomyces cerevisiae
  misc_feature (0)...(0): Polypeptide Accession Number YER095W
MSQVQEQHISESQLQYGNGSLMSTVPADLSQSVVDGNGNGSSEDIEATNGSGDGGGLQEQAEAQGEMEDEAYDEAALGSFVPIEKLQVNGITMADVKKLRESGLHTAEAVAYAPRKDLLEIKGISEAKADKLLNEAARLVPMGFVTAADFHMRRSELICLTTGSKNLDTLLGGGVETGSITELFGEFRTGKSQLCHTLAVTCQIPLDIGGGEGKCLYIDTEGTFRPVRLVSIAQRFGLDPDDALNNVAYARAYNADHQLRLLDAAAQMMSESRFSLIVVDSVMALYRTDFSGRGELSARQMHLAKFMRALQRLADQFGVAVVVTNQVVAQVDGGMAFNPDPKKPIGGNIMAHSSTTRLGFKKGKGCQRLCKVVDSPCLPEAECVFAIYEDGVGDPREEDE

SEQ ID NO: 248 - protein, 318 aa, Saccharomyces cerevisiae
  misc_feature (0)...(0): Polypeptide Accession Number YER099C
MSTNSIKLLAGNSHPGLAELISQRLGVPLSKVGVYQYSNKETSVTIGESIRDEDVYIIQTGYGEHEINDFLMELLILIHACKTASVRRITAVIPNFPYARQDKKDKSRAPITAKLIANLLETAGCDHVITMDLHASQIQGFFHIPVDNLYGEPSVLNYIRTKTDFNNAILVSPDAGGAKRVASLADKLDMNFALIHKERQKANEVSRMLLVGDVAGKSCLLIDDMADTCGTLVKACDTLMDHGAKEVIAIVTHGIFSGSAREKLINSRLSRIVCTNTVPVDLDLDIVDQVDISPTIAEAIRRLHNGESVSYLFTHAPV

SEQ ID NO: 249 - protein, 200 aa, Saccharomyces cerevisiae
  misc_feature (0)...(0): Polypeptide Accession Number YER102W
MGISRDSRHKRSATGAKRAQFRKKRKFELGRQPANTKIGAKRIHSVRTRGGNKKYRALRIETGNFSWASEGISKKTRIAGVVYHPSNNELVRTNTLTKAAIVQIDATPFRQWFEAHYGQTLGKKKNVKEEETVAKSKNAERKWAARAASAKIESSVESQFSAGRLYACISSRPGQSGRCDGYILEGEELAFYLRRLTAKK

SEQ ID NO: 250 - protein, 1391 aa, Saccharomyces cerevisiae
  misc_feature (0)...(0): Polypeptide Accession Number YER105C
MYSTPLKKRIDYDRETFTASASLGGNRLRNRPRDDQNNGKPNLSSRSFLSERKTRKDVLNKYGEAGNTIESELRDVTTHVKISGLTSSEPLQLASEFVQDLSFRDRNTPILDNPDYYSKGLDYNFSDEVGGLGAFTPFQRQQVTNIPDEVLSQVSNTEIKSDMGIFLELNYCWITSDNKLILWNINNSSEYHCIDEIEHTILKVKLVKPSPNTFVSSVENLLIVATLFDIYILTISFNDRTHELNIFNTGLKVNVTGFNVSNIISYERTGQIFFTGATDGVNVWELQYNCSENLFNSKSNKICLTKSNLANLLPTKLIPSIPGGKLIQKVLEGDAGTEEETISQLEVDQSRGVLHTLSTKSIVRSYLITSNGLVGPVLIDAAHIRRGMNALGVKNSPLLSNRAFKIAKIVSISMCENNDLFLAVITTTGVRLYFKGSISRRSIGSLKLDSVKFPPTSISSSLEQNKSFIIGHHPLNTHDTGPLSTQKASSTYINTTCASTIISPGIYFTCVRKRANSGELSKGITNKALLENKEEHKLYVSAPDYGILKNYGKYVENTALLDTTDEIKEIVPLTRSFNYTSTPQGYANVFASQYSAEPLKVAVLTSNALEIYCYRTPDEVFESLIENPLPFIHSYGLSEACSTALYLACKFNKSEHIKSSALAFFSAGIPGVVEIKPKSSRESGSVPPISQNLFDKSGECDGIVLSPRFYGSALLITRLFSQIWEERVFVFKRASKTEKMDAFGISITRPQVEYYLSSISVLADFFNIHRPSFVSFVPPKGSNAITASDAESIAMNALILLINSIKDALSLINVFYEDIDAFKSLLNTLMGAGGVYDSKTREYFFDLKFHDLFTPNAKTKQLIKEILIEVVNANIASGTSADYIVNVLKERFGSFCHSADILCYRAGEHLEAAQKFEMIDSKISRNHLDTAIDLYERCAENIELCELRRVVDIMVKLNYQPKTVGFLLRFADKIDKGNQAQEYVSRGCNTADPRKVFYDKRINVYTLIFEIVKSVDDYTSIEQSPSIANISIFSPASSLKKRVYSVIMNSNNRFFHYCFYDWLVANKRQDYLLRLDSQFVLPYLKERAEKSLEISNLLWFYLFKEEHFLEAADVLYALASSDFDLKLSERIECLARANGLCDSSTSFDQKPALVQLSENIHELFDIASIQDDLLNLVRNETRIDEDYRKQLTLKLNGRVLPLSDLFNDCADPLDYYEIKLRIFKVSQFKDEKVIQGEWNRLLDSMKNAPSPDVGSVGQESFLSSISNTLIRIGKTTRDTDVVFPVHFLMNKILESFIDKSSAADGSVCSMFLLAGVSHLKLYYILSRIIENSEGNVELAKKEMVWLIKDWYQSDSDLRGSIAPEQIKKLEKYDPNTDPVQDYVKDRHHGLK

SEQ ID NO: 251 - protein, 302 aa, Saccharomyces cerevisiae
  misc_feature (0)...(0): Polypeptide Accession Number YER106W
MREKRTISNKDTNYLKFPNKLQRYSRFLSRKISNTSPEKQPKKNIKEHCLSSYHKEHSVKPKQNSGNVAAKEDKDTQHLQNNVANEEATECLTRSNLKKLQEKIFDRELNDIACDHCLCSTENRRDIKYSRLWFLFELEMSENWNENLRLSCYNKYVYSAIDESWKMENILLKEQEKHYEYFPIGQLLIPNNIDYTNKQKRKENIEDLTIEIDSIIETNHQKKRFLPQSVLIKREDEIAFDDFHLDARKVLNDLSATSENPFSSSPNTKKIKSKGKTLEVVPKKKNKKIIGALERKLHIDEN

SEQ ID NO: 252 - protein, 274 aa, Saccharomyces cerevisiae
  misc_feature (0)...(0): Polypeptide Accession Number YER116C
MARRPDNQNPEGENLRIKRVRLESVRQNDEEEENEVSRTQNIVTDNRHDSPEAVVEIIGERALENTSEEDGDDDLSLFRALEEDPGSDHNTSNNDSGNHDRETMHTEEPEASSGNNITLTNNVEELHTMDVLSQTANTPSASPMLDAAPPTTKPGTNSKEQTVDLTADAIDLDAEEQQVLQISDDDFQEETKEAPKEYGAAKDYRCPICFEPPETALMTLCGHVFCCPCLFQMVNSSRTCRQFGHCALCRSKVYLKDVRLIILRKKQVKKKVKS

SEQ ID NO: 253 - protein, 261 aa, Saccharomyces cerevisiae
  misc_feature (0)...(0): Polypeptide Accession Number YER126C
MPQNDYIERHIKQHGKRLDHEERKRKREARESHKISERAQKLTGWKGKQFAKKRYAEKVSMRKKIKAHEQSKVKGSSKPLDTDGDALPTYLLDREQNNTAKAISSSIKQKRLEKADKFSVPLPKVRGISEEEMFKVIKTGKSRSKSWKRMITKHTFVGEGFTRRPVKMERIIRPSALRQKKANVTHPELGVTVFLPILAVKKNPQSPMYTQLGVLTKGTIIEVNVSELGMVTAGGKVVWGKYAQVTNEPDRDGCVNAVLLV

SEQ ID NO: 254 - protein, 357 aa, Saccharomyces cerevisiae
  misc_feature (0)...(0): Polypeptide Accession Number YER127W
MSELNALLKDINGSLTATSESLERLSGIYSNSATDEIPESNQLHEHLFYDAKKPAEKVSLLSLKNGSMLGYINSLLMLIGNRLDDECKDPSAMDARERSIQHRVVLERGVKPLEKKLAYQLDKLTRAYVKMEKEYKDAEKRALEKSTLVNHSGNDDSEDDESSEDEIAYRPNTSGIINTNKKSSAYRVEETAKQENGEENDDNETGVYKPPKITAVLPPQQTHFEDRFDAREHKDRSNKSRMQAMEEYIRESSDQPDWSASIGADIVNHGRGGIKSLRDTEKERRVTSFEEDNFTRLNITNKAEKRKQKQRERNARMNVIGGEDFGIFSSKRKLEDSTSRRGAKKTRSAWDRAQRRL

SEQ ID NO: 255 - protein, 119 aa, Saccharomyces cerevisiae
  misc_feature (0)...(0): Polypeptide Accession Number YER131W
MPKKRASNGRNKKGRGHVKPVRCVNCSKSIPKDKAIKRMAIRNIVEAAAVRDLSEASVYPEYALPKTYNKLHYCVSCAIHARIVRVRSREDRKNRAPPQRPRFNRDNKVSPAAAAKKAL

SEQ ID NO: 256 - protein, 312 aa, Saccharomyces cerevisiae
  misc_feature (0)...(0): Polypeptide Accession Number YER133W
MDSQPVDVDNIIDRLLEVRGSKPGQQVDLEENEIRYLCSKARSIFIKQPILLELEAPIKICGDIHGQYYDLLRLFEYGGFPPESNYLFLGDYVDRGKQSLETICLLLAYKIKYPENFFILRGNHECASINRIYGFYDECKRRYNIKLWKTFTDCFNCLPIAAIIDEKIFCMHGGLSPDLNSMEQIRRVMRPTDIPDVGLLCDLLWSDPDKDIVGWSENDRGVSFTFGPDVVNRFLQKQDMELICRAHQVVEDGYEFFSKRQLVTLFSAPNYCGEFDNAGAMMSVDESLLCSFQILKPAQKSLPRQAGGRKKK

SEQ ID NO: 257 - protein, 805 aa, Saccharomyces cerevisiae
  misc_feature (0)...(0): Polypeptide Accession Number YER144C
MGSEQALSEVVESAKERFGRLRHLVQKFLDDDDVPQECLPLLQECAEIWSSYVDACQDITMQAPKEDANRLSKGFLRLNETAFLYYMIVYTLLEDTLPRLKEFSSNKDQNVRNLYGERIQLLHNDPNIERIRNVIENYPKFIQLQTIEPGKLSSMLHFHGDALLLIDVRPRSEFVRAHIKCKNIICIDPASFKDSFTDQQIESVSLITSPHSDITFFSNRDKFKFIILYTDTQLHNNFQQRQTRILAKILSQNSVIKPLSGTKILILENGFSNWVKLGGAYQSSVSETAHLTSSSSTPAFGSPQVPTGLFNQKSLSPNKDKSMPMVSMNTQPLLTTVQRPQLPLYYSDLPIIPQPSPNRNSPTVQKFSPHPPTTLSKLNTPSTIQNKANTVERISPDIRAAQAHAYLPPASNVFSPRIPPLPQQNLSSSRQTILNNSQVLDLDLIVGLENIGNCCYMNCILQCLVGTHDLVRMFLDNTYLNFINFDSSRGSKGLLAKNFAILVNNMHRHGAFTPPNVRTIPVQTIQFKKICGHINPMYSDSMQQDCQEFCQFLLDGLHEDLNQNGSKKHLKQLSDEEERMREKMSIRKASALEWERFLLTDFSAIIDLFQGQYASRLQCQVCEHTSTTYQTFSVLSVPVPRVKTCNILDCFREFTKCERLGVDEQWSCPKCLKKQPSTKQLKITRLPKKLIINLKRFDNQMNKNNVFVQYPYSLDLTPYWARDFNHEAIVNEDIPTRGQVPPFRYRLYGVACHSGSLYGGHYTSYVYKGPKKGWYFFDDSLYRPITFSTEFITPSAYVLFYERIF

SEQ ID NO: 258 - protein, 801 aa, Saccharomyces cerevisiae
  misc_feature (0)...(0): Polypeptide Accession Number YER157W
MARSRKNSLVRDIASHPTIPESQTIVGLLDDSYLFDKLKKLSLAVENSDSLQRTDVSEGCSEVNGSEATTSADVKKTNKYLYYTTYLDQLNIKIDEYKVVLDQTRQVNDQLDSSIKKFRKISQDTGAFIEETKTIYEKQSKLSNLTESIPKALHYFEVLDPIMRRLNHATSPAIVKKSSFTTMLATIDESLRFLDENSDLKDAAAYRIKFKQCLIRACELISHFLTNLLKQTNQEILDKTKNKNSLTGLPSTTRDAFLYSKFYTIADTFKIQVSEIVKRSNEKAYNKYHDELNSILYECFNHYFQTRLRLLTPVIWSHIDEIVVKDKDQGLVKFIQDGKVYFQQLCADEYKLFVEFFPEKECRFKINQWFLQLCEPLYDSIRVRVLKETDICTLCDSVTLFAPYYEFEEGSEEYVKQFTDIQYDKLFEPIVQKVQARLILRVQIYVQQNILSYRPTRDVFMISNRRRKSKTSLQGGNEDATTSDDNPDPLLESYLSSFKNRSILPISPNDADDKSIDSEESTDKISQLQTYYPPLLKTLALLSKIYEMINSVVFDDLAHHVVHDCIVSLRNAYDMVIKSSAGKSDFNNLDISLAYLKNLLMLRDSIQNFNIQYTVNETYLDFSGVEGFFKSLKENGRNVLKKTKSSSILTLARELVPKVVNNMVDARTELISELRNVIKDFTESTSLELIDDTLDINSDEDLLSKNVKLRENIKARLPRIYEQILNYIDDQEIVTNLLDAVQELITQSYSKYYETITELAENGKFAKDQVADVMYLDVFTDFFAKEVADLLRNGDIDTITK

SEQ ID NO: 259 - protein, 244 aa, Saccharomyces cerevisiae
  misc_feature (0)...(0): Polypeptide Accession Number YER174C
MTVVEIKSQDQFTQLTTTNAANKLIVLYFKAQWADPCKTMSQVLEAVSEKVRQEDVRFLSIDADEHPEISDLFEIAAVPYFVFIQNGTIVKEISAADPKEFVKSLEILSNASASLANNAKGPKSTSDEESSGSSDDEEDETEEEINARLVKLVQAAPVMLFMKGSPSEPKCGFSRQLVGILREHQIRFGFFDILRDENVRQSLKKFSDWPTFPQLYINGEFQGGLDIIKESIEEDPEYFQHALQ

SEQ ID NO: 260 - protein, 334 aa, Saccharomyces cerevisiae
  misc_feature (0)...(0): Polypeptide Accession Number YER179W
MSVTGTEIDSDTAKNILSVDELQNYGINASDLQKLKSGGIYTVNTVLSTTRRHLCKIKGLSEVKVEKIKEAAGKIIQVGFIPATVQLDIRQRVYSLSTGSKQLDSILGGGIMTMSITEVFGEFRCGKTQMSHTLCVTTQLPREMGGGEGKVAYIDTEGTFRPERIKQIAEGYELDPESCLANVSYARALNSEHQMELVEQLGEELSSGDYRLIVVDSIMANFRVDYCGRGELSERQQKLNQHLFKLNRLAEEFNVAVFLTNQVQSDPGASALFASADGRKPIGGHVLAHASATRILLRKGRGDERVAKLQDSPDMPEKECVYVIGEKGITDSSD

SEQ ID NO: 261 - protein, 267 aa, Saccharomyces cerevisiae
  misc_feature (0)...(0): Polypeptide Accession Number YER180C
MDVDERLHQDENQTHPFSQKKSSSFLIKEKAATKSKDLEHIRLRDLNFNHRKKLDDKKLAKQIPVKANFKKPNEIEARANLNSNELTDINLDYIPDSPSIEKISGPEDSIVVTPRNIIHLQSDSDIILEECEHNYDCSPFYRLFNYENRIEPDDYEAIINAIITDEIAGTYPVFERELEYQELKSLVRKRDYIMYYFLSRDYRGFFQLKEERTLFYRYPSIAYTSPLRYLDNGSETEQFTGDDDEELQSFDFENTSSVRTLDSNIWR

SEQ ID NO: 262 - protein, 306 aa, Saccharomyces cerevisiae
  misc_feature (0)...(0): Polypeptide Accession Number YER186C
MLWHPDGYEPRVKAIEEEIYANEDRKDVPDKFKFDTVTKTGMVKLRVFKDDLIFKSQRSINLFASRKHPFKSFTADGEGLPLFAFRTKKPFFVRRDYVGFLFYQYEILKNGDFPEESDYEVKGECDGFTLFKVLFCTVKVKKTSYYRNKERISHILELNFGKKEDFRILTLVRCSEIRSVYVVEDKKVIMKWVFTSESKFNLNSSLFIIKAAIGCLPEVGDSIEDIPKFDWDSCPTIGCMCRTKEALFQPESRKDMHICPQLFLGETGPPHYNESSVPWLTKMNICISVLINFLEYTDFMSWMQDN

SEQ ID NO: 263 - protein, 1770 aa, Saccharomyces cerevisiae [sequence omitted]

SEQ ID NO: 264 - protein, 779 aa, Saccharomyces cerevisiae
  misc_feature (0)...(0): Polypeptide Accession Number YFL009W
MGSFPLAEFPLRDIPVPYSYRVSGGIASSGSVTALVTAAGTHRNSSTAKTVETEDGEEDIDEYQRKRAAGSGESTPERSDFKRVKHDNHKTLHPVNLQNTGAASVDNDGLHNLTDISNDAEKLLMSVDDGSAAPSTLSVNMGVASHNVAAPTTVNAATITGSDVSNNVNSATINNPMEEGALPLSPTASSPGTTTPLAKTTKTINNNNNIADLIESKDSIISPEYLSDEIFSAINNNLPHAYFKNLLFRLVANMDRSELSDLGTLIKDNLKRDLITSLPFEISLKIFNYLQFEDIINSLGVSQNWNKIIRKSTSLWKKLLISENFVSPKGFNSLNLKLSQKYPKLSQQDRLRLSFLENIFILKNWYNPKFVPQRTTLRGHMTSVITCLQFEDNYVITGADDKMIRVYDSINKKFLLQLSGHDGGVWALKYAHGGILVSGSTDRTVRVWDIKKGCCTHVFKGHNSTVRCLDIVEYKNIKYIVTGSRDNTLHVWKLPKESSVPDHGEEHDYPLVFHTPEENPYFVGVLRGHMASVRTVSGHGNIVVSGSYDNTLIVWDVAQMKCLYILSGHTDRIYSTIYDHERKRCISASMDTTIRIWDLENIWNNGECSYATNSASPCAKILGAMYTLQGHTALVGLLRLSDKFLVSAAADGSIRGWDANDYSRKFSYHHTNLSAITTFYVSDNILVSGSENQFNIYNLRSGKLVHANILKDADQIWSVNFKGKTLVAAVEKDGQSFLEILDFSKASKINYVSNPVNSSSSSLESISTSLGLTRTTIIP

SEQ ID NO: 265 - protein, 211 aa, Saccharomyces cerevisiae
  misc_feature (0)...(0): Polypeptide Accession Number YFL010C
MAQSKSNPPQVPSGWKAVFDDEYQTWYYVDLSTNSSQWEPPRGTTWPRPKGPPPGVNNEKSSRQQADQAPPPYSSQSTPQVQAGAQAQQPRYYQPQQPQYPQYPQQQRYYPQQAPMPAAAPQQAYYGTAPSTSKGSGHGGAMMGGLLGVGAGLLGGAMLEHAFDDHNYDGPDTVVVENNYYGDDAGGSDGGFDDAGGFDGGFDDGFDGSDF

SEQ ID NO: 266 - protein, 159 aa, Saccharomyces cerevisiae
  misc_feature (0)...(0): Polypeptide Accession Number YFL017C
MSLPDGFYIRRMEEGDLEQVTETLKVLTTVGTITPESFSKLIKYWNEATVWNDNEDKKIMQYNPMVIVDKRTETVAATGNIIIERKIIHELGLCGHIEDIAVNSKYQGQGLGKLLIDQLVTIGFDYGCYKIILDCDEKNVKFYEKCGFSNAGVEMQIRK

SEQ ID NO: 267 - protein, 796 aa, Saccharomyces cerevisiae
  misc_feature (0)...(0): Polypeptide Accession Number YFL023W
MDLLAASVESTLKNLQDKRNFLSEQREHYIDIRSRLVRFINDNDDGEEEGEGQGMVFGDIIISTSKIYLSLGYEYYVEKTKEEAITFVDDKLKLMEDAIEQFNLKIEEAKKTLDNLNHMEDGNGIEEDEANNDEDFLPSMEIREELDDEGNVISSSVTPTTKQPSQSNSKKEQTPAVGPKEKGLAKEKKSKSFEENLKGKLLKRNDEVKKKVQPSKVDTENVYTFADLVQQMDQQDELEDGYIETDEINYDYDAFENSNFKVNDNYEEDDEDEDEEEYLNHSIIPGFEAQSSFLQQIQRLRAQKQSQDHEREEGDVNKSLKPILKKSSFAENSDKKQKKKQVGFASSLEIHEVENLKEENKRQMQSFAVPMYETQESTGIANKMTSDEFDGDLFAKMLGVQEADEVHEKYKEELINQERLEGEASRSNRRTRVSRFRKDRASKKENTLSTFKQETTRSVENEVVEKEPVVGDIIEKEPVVGDVIEKEPVVGDVIEKEPAVTDIVEREPAVNDIVERKPVVGDIIEKEPTINDIVEKEPEINSKSEFETPFKKKKLKSLQKPRSSKSMKKKFDPKILENISDDDYDDDDDGNKKLLSNKSKNNTDEQDKFPSKIQEVSRSMAKTGATVGSEPVRITNVDYHALGGNLDDMVKAYSLGLYDDDLEEDPGTIVEKLEDFKEYNKQVELLRDEIRDFQLENKPVTMEEEENDGNVMNDIIEHEFPESYTNDEDEVALHPGRLQEEVAIEYRRLKEATASKWQSSSPAAHTEGELEPIDKFGNPVKTSRFRSQRLHMDSKP

SEQ ID NO: 268 - protein, 368 aa, Saccharomyces cerevisiae
  misc_feature (0)...(0): Polypeptide Accession Number YFL029C
MKLDSIDITHCQLVKSTRTARIYRSDTYAIKCLALDFDIPPHNAKFEVSILNKLGNKCKHILPLLESKATDNNDLLLLFPFEEMNLYEFMQMHYKRDRRKKNPYYDLLNPSIPIVADPPVQKYTNQLDVNRYSLSFFRQMVEGIAFLHENKIIHRDIKPQNIMLTNNTSTVSPKLYIIDFGISYDMANNSQTSAEPMDSKVTDISTGIYKAPEVLFGVKCYDGGVDVWSLLIIISQWFQRETSRMGHVPAMIDDGSDDMNSDGSDFRLICSIFEKLGIPSIQKWEEVAQHGSVDAFVGMFGADGDGKYVLDQEKDVQISIVERNMPRLDEIADVKVKQKFINCILGMVSFSPNERWSCQRILQELEKP

SEQ ID NO: 269 - protein, 259 aa, Saccharomyces cerevisiae
  misc_feature (0)...(0): Polypeptide Accession Number YFL035C
MNTIYSSPHSSNSRLSLRNKHHSPKRHSQTSFPAQKSTPQSQQLTSTTPQSQQQEASERSESQQIMFLSEPFVRTALVKGSFKTIVQLPKYVDLGEWIALNVFEFFTNLNQFYGVVAEYVTPDAYPTMNAGPHTDYLWLDANNRQVSLPASQYIDLALTWINNKVNDKNLFPTKNGLPFPQQFSRDVQRIMVQMFRIFAHIYHHHFDKIVHLSLEAHWNSFFSHFISFAKEFKIIDRKEMAPLLPLIESFEKQGKIIYN

SEQ ID NO: 270 - protein, 212 aa, Saccharomyces cerevisiae
  misc_feature (0)...(0): Polypeptide Accession Number YFL056C
MADLFAPAPEPSTELGRLRVLSKSAGIRVSPLILGGMSIGDAWSEILGSMSKERAFELLDAFYEAGGNFIDTANNYQNEQSEAWIGEWMVSRKLRDQIVIATKFTTDYKKYDVGGGKSANYCGNHKRSLHVSVRDSLRKLQTDWIDILYVHWWDYMSSIEEVMDSLHILVQQARSSIWVCLIRLPGLFLRQITTLNLMVKPLLASIKVNGTC

SEQ ID NO: 271 - protein, 298 aa, Saccharomyces cerevisiae
  misc_feature (0)...(0): Polypeptide Accession Number YFL059W
MSEFKVKTGLAQMLKGGVIMDVVTPEQAIIAERAGACAVMALERIPADMRKSGQVCRMSDPRMIKEIMEAVSIPVMAKVRIGHFVEAQILEELQVDYIDESEVLTPADWTHHIEKHNFKVPFVCGAKDLGEALRRINEGAAMIRTKGEAGTGDVSEAVKHITKIKAEIQQYKENLKTESDFAAKATELRVPVDLLKTTLSEGKLPVVNFAAGGVATPADAALLMQLGCEGVFVGSGIFKSSDPEKLACAIVEATTHYDNPAKLLQVSSDLGDLMGGISIQSINEAGGKNGARLSEIGW

SEQ ID NO: 272 - protein, 222 aa, Saccharomyces cerevisiae
  misc_feature (0)...(0): Polypeptide Accession Number YFL060C
MTVVIGVLALQGAFIEHVRHVEKCIVENRDFYEKKLSVMTVKDKNQLAQCDALIIPGGESTAMSLIAERTGFYDDLYAFVHNPSKVTWGTCAGLIYISQQLSNEAKLVKTLNLLKVKVKRNAFGRQAQSSTRICDFSNFIPHCNDFPATFIRAPVIEEVLDPEHVQVLYKLDGKDNGGQELIVAAKQKNNILATSFHPELAENDIRFHDWFIREFVLKNYSK

SEQ ID NO: 273 - protein, 225 aa, Saccharomyces cerevisiae
  misc_feature (0)...(0): Polypeptide Accession Number YFL061W
MSQYGFVRVPREVEKAIPVVNAPRPRAVVPPPNSETARLVREYAAKELTAPVLNHSLRVFQYSVAIIRDQFPAWDLDQEVLYVTCLLHDIATTDKNMRATKMSFEYYGGILSRELVFNATGGNQDYADAVTEAIIRHQDLTGTGYITTLGLILQIATTLDNVGSNTDLIHIDTVSAINEQFPRLHWLSCFATVVDTENSRKPWGHTSSLGDDFSKKVICNTFGYN

SEQ ID NO: 274 - protein, 839 aa, Saccharomyces cerevisiae
  misc_feature (0)...(0): Polypeptide Accession Number YFR002W
MLETLRGNKLHSGTSKGANKKLNELLESSDNLPSASSELGSIQVSINELRRRVFQLRSKNKASKDYTKAHYLLANSGLSFEDVDAFIKDLQTNQFLEPNPPKIIESEELEFYIRTKKEENILMSIEQLLNGATKDFDNFINHNLNLDWAQHKNEVMKNFGILIQDKKTVDHKKSISSLDPKLPSWGNKGNNILNSNESRLNVNENNILREKFENYARIVFQFNNSRQANGNFDIANEFISILSSANGTRNAQLLESWKILESMKSKDINIVEVGKQYLEQQFLQYTDNLYKKNMNEGLATNVNKIKSFIDTKLKKADKSWKISNLTVINGVPIWALIFYLLRAGLIKEALQVLVENKANIKKVEQSFLTYFKAYASSKDHGLPVEYSTKLHTEYNQHIKSSLDGDPYRLAVYKLIGRCDLSRKNIPAVTLSIEDWLWMHLMLIKEKDAENDPVYERYSLEDFQNIIISYGPSRFSNYYLQTLLLSGLYGLAIDYTYTFSEMDAVHLAIGLASLKLFKIDSSTRLTKKPKRDIRFANILANYTKSFRYSDPRVAVEYLVLITLNEGPTDVELCHEALRELVLETKEFTVLLGKIGRDGARIPGVIEERQPLLHVRDEKEFLHTITEQAARRADEDGRIYDSILLYQLAEEYDIVITLVNSLLSDTLSASDLDQPLVGPDDNSETNPVLLARRMASIYFDNAGISRQIHVKNKEICMLLLNISSIRELYFNKQWQETLSQMELLDLLPFSDELSARKKAQDFSNLDDNIVKNIPNLLIITLSCISNMIHILNESKYQSSTKGQQIDSLKNVARQCMIYAGMIQYRMPRETYSTLINIDVSL

SEQ ID NO: 275 - protein, 221 aa, Saccharomyces cerevisiae
  misc_feature (0)...(0): Polypeptide Accession Number YFR008W
MSDQINVLSMQQQQQQQQQQQQVYMSPQAENLNHMYLLVNKLVKQLRENQAEKAKILRNIDILSGSLNKYETSEEPHDTTENIALFNRFLEQRGKAPITEKEQLSNNLDENAKDDVMLGVLKRQNSMLRKSLQESKQVTLESMDLLSYSEDSLNYIVAQLRGNILMHHKETIKLIRQKFQTETIPLEDEEFKMYLENVNGLQKLTDISHTYRLLLRLHAQD

SEQ ID NO: 276 - protein, 451 aa, Saccharomyces cerevisiae
  misc_feature (0)...(0): Polypeptide Accession Number YFR024C-A
MGINNPIPRSLKSETNFVKPNQVFGADQVIPPDVLKRAKGLAIITILKAGFLFSGRAGSGVIVARLKDGTWSAPSAIAMAGAGAGGMVGIELTDFVFILNTQDAVKSFSEFGTITLGGNVSVSAGPLGRSAEAAASASAGGVAAVFAYSKSKGLFAGVSVEGSAIIERREANRKFYGDNCTAKMILSGRIRPPPAVDPLFRVLESRAFNYRPSNGGRGSFDDDEDDYYDDDDYYNDIPSSFSSTDASSTRPNTRSTRRRAQSGSRYTFDDDDDDDDYGTGYSRNSRLAPTNSGGSGGKLDDPSGASSYYASHRRSGTAQSRARSSRNRWADDEYDDYDDDYESGYRRGNGRDRTKDREVDDLSNRFSKSRISSASTPQTSQGRFTAPTSPSTSSPKAVALYSFAGEESGDLPFRKGDVITILKKSDSQNDWWTGRVNGREGIFPANYVELV

SEQ ID NO: 277 - protein, 147 aa, Saccharomyces cerevisiae
  misc_feature (0)...(0): Polypeptide Accession Number YFR033C
MGMLELVGEYWEQLKITVVPVVAAAEDDDNEQHEEKAAEGEEKEEENGDEDEDEDEDEDDDDDDDEDEEEEEEVTDQLEDLREHFKNTEEGKALVHHYEECAERVKIQQQQPGYADLEHKEDCVEEFFHLQHYLDTATAPRLFDKLK

SEQ ID NO: 278 - protein, 557 aa, Saccharomyces cerevisiae
  misc_feature (0)...(0): Polypeptide Accession Number YFR037C
MSDTEKDKDVPMVDSHEATEEPPTTSTNTPSFPHLAQEQAKEESATLGAEVAHKKINYEQEAQKLEEKALRFLAKQTHPVIIPSFASWFDISKIHEIEKRSNPDFFNDSSRFKTPKAYKDTRNFIINTYRLSPYEYLTITAVRRNVAMDVASIVKIHAFLEKWGLINYQIDPRTKPSLIGPSFTGHFQVVLDTPQGLKPFLPENVIKQEVEGGDGAEPQVKKEFPVNLTIKKNVYDSAQDFNALQDESRNSRQIHKVYICHTCGNESINVRYHNLRARDTNLCSRCFQEGHFGANFQSSDFIRLENNGNSVKKNWSDQEMLLLLEGIEMYEDQWEKIADHVGGHKRVEDCIEKFLSLPIEDNYIREVVGSTLNGKGGDSRDGSVSGSKLMECVNDAVQTLLQGDDKLGKVSDKSREISEKYIEESQAIIQELVKLTMEKLESKFTKLCDLETQLEMEKLKYVKESEKMLNDRLSLSKQILDLNKSLEELNVSKKLVLISEQVDSGIQLVEKDQEGDDEDGNTATGHGVKRVGKEGEEVGEGDSIAKLQPQVYKPWSL

SEQ ID NO: 279 - protein, 200 aa, Saccharomyces cerevisiae
  misc_feature (0)...(0): Polypeptide Accession Number YFR042W
MAGIKLTHKLYQYYQLATSFLYAALLIRWLILMPLVGSRFLPGGIHEFLIYLMFYSSIMEVIWLLRFHGFKYGLLSRTFLKDLNFIYLVSVIHFYDDYEHALILKNASYSSFIISLSLSQAYCHWCKLFKRKGVKERTLVWKVNTFVTLPILYLSEFALLLLNIQVKNYHSTPTLDIINRVVLLAYFPVLLTAYKKLLTK

SEQ ID NO: 280 - protein, 237 aa, Saccharomyces cerevisiae
  misc_feature (0)...(0): Polypeptide Accession Number YFR043C
MVLQYPQNKILVLSDHPHNFLKTQFLQDLFHCSSTGISIVKDQTWENRYYKVHFDLYIDSCKEIPVWVEEFITPECEPLRNVMAGIILITDIRQTKPQELLHQFMIAAHRNTFVVLANVNEEVEQDEIDELNEIWSNAFTNVIEFVNWKRSKPTVNHNDYGEKLGLDRIQEIIDTHDWLNCEVQPATKIREEIPNEMPLEQIIRNLQSARLKYKSIENSSEADAFANEMADELSRYL

SEQ ID NO: 281 - protein, 295 aa, Saccharomyces cerevisiae
  misc_feature (0)...(0): Polypeptide Accession Number YFR047C
MPVYEHLLPVNGAWRQDVTNWLSEDVPSFDFGGYVVGSDLKEANLYCKQDGMLCGVPFAQEVFNQCELQVEWLFKEGSFLEPSKNDSGKIVVAKITGPAKNILLAERTALNILSRSSGIATASHKIISLARSTGYKGTIAGTRKTTPGLRRLEKYSMLVGGCDTHRYDLSSMVMLKDNHIWATGSITNAVKNARAVCGFAVKIEVECLSEDEATEAIEAGADVIMLDNFKGDGLKMCAQSLKNKWNGKKHFLLECSGGLNLDNLEEYLCDDIDIYSTSSIHQGTPVIDFSLKLAH

SEQ ID NO: 282 - protein, 274 aa, Saccharomyces cerevisiae
  misc_feature (0)...(0): Polypeptide Accession Number YFR052W
MPSLAELTKSLSIAFENGDYAACEKLLPPIKIELIKNNLLIPDLSIQNDIYLNDLMITKRILEVGALASIQTFNFDSFENYFNQLKPYYFSNNHKLSESDKKSKLISLYLLNLLSQNNTTKFHSELQYLDKHIKNLEDDSLLSYPIKLDRWLMEGSYQKAWDLLQSGSQNISEFDSFTDILKSAIRDEIAKNTELSYDFLPLSNIKALLFFNNEKETEKFALERNWPIVNSKVYFNNQSKEKADYEDEMMHEEDQKTNIIEKAMDYAISIENIV

SEQ ID NO: 283 - protein, 151 aa, Saccharomyces cerevisiae
  misc_feature (0)...(0): Polypeptide Accession Number YFR057W
MIFGPTSVYSKCSAKSSGIIKDTAKLPISRVRIKVMLEITVSFLFFDRFPRSFLNHNLYDSICPFFAWQYTSYYLSIYRQSFLFHFLQKDFSNDFVSEELIYALVALGAKNSFDNSLSKHTYEYYNHSKRNLLEDSTNKNSAFSSASVTKP

SEQ ID NO: 284 - protein, 130 aa, Saccharomyces cerevisiae
  misc_feature (0)...(0): Polypeptide Accession Number YGL015C
MEDTIRPLNYADIETSGPINLLETTNNLKSSLKKFSQKAKGSHISRERIHHFRKWKNKTESLSENHLKPPPDVDSLCFSNCFQPDALSGNVFLPPRSSNMYWNEKQLQLEMEILKFLSLNTSNECCTSDD

SEQ ID NO: 285 - protein, 278 aa, Saccharomyces cerevisiae
  misc_feature (0)...(0): Polypeptide Accession Number YGL019W
MSQEFVEDYSRTGSSDDEDSGAYDEWIPSFCSRFGHEYFCQVPTEFIEDDFNMTSLSQEVPHYRKALDLILDLEAMSDEEEDEDDVVEEDEVDQEMQSNDGHDEGKRRNKSPVVNKSIIEHAAEQLYGLIHARFILTKPGLQAMAEKFDHKEFGTCPRYYCNGMQLLPCGLSDTVGKHTVRLYCPSCQDLYLPQSSRFLCLEGAFWGTSFPGVFLKHFKELEEYVERKSKESYELKVFGFRINDEAVSGPRMKWLRQYPSTEEDWEEFAKCEFETPAV

SEQ ID NO: 286 - protein, 111 aa, Saccharomyces cerevisiae
  misc_feature (0)...(0): Polypeptide Accession Number YGL024W
MFAIICMNSLNCNRNGRISSRASLICLHTLSLVSFSFLANITCKSSSLTPAGIIESIPVVFTAVVSVLRCLIEEVLVTVSVVLFKISLGAIPKILRKVLVLYIILYYIILY

SEQ ID NO: 287 - protein, 431 aa, Saccharomyces cerevisiae
  misc_feature (0)...(0): Polypeptide Accession Number YGL025C
MAPSEILKRTTETVTKTSSIRQRKTDTTAVKTTGMDSIIPAGVKLDDLQVILAKNENETRDKVCKQINEARDEILPLRLQFNEFIQIMANIDQEGSKQADRMAKYLHIRDKILQLNDRFQTLSSHLEALQPLFSTVPEYLKTADNRDRSFQLLEPLSTYNKNGNAVCSTATVVSTNHSAAASTPTTTATPHANPITHAHSLSNPNSTATMQHNPLAGKRGPKSGSTMGTPTVHNSTAAAPIAAPKKPRKPRQTKKAKAQAQAQAQAQAQVYAQQSTVQTPITASMAAALPNPTPSMINSVSPTNVMGTPLTNMMSPMGNAYSMGAQNQGGQVSMSQFNGSGNGSNPNTNTNSNNTPLQSQLNLNNLTPANILNMSMNNDFQQQQQQQQQQQQPQPQYNMNMGMNNMNNGGKELDSLDLNNLELGGLNMDFL

SEQ ID NO: 288 - protein, 707 aa, Saccharomyces cerevisiae
  misc_feature (0)...(0): Polypeptide Accession Number YGL026C
MSEQLRQTFANAKKENRNALVTFMTAGYPTVKDTVPILKGFQDGGVDIIELGMPFSDPIADGPTIQLSNTVALQNGVTLPQTLEMVSQARNEGVTVPIILMGYYNPILNYGEERFIQDAAKAGANGFIIVDLPPEEALKVRNYINDNGLSLIPLVAPSTTDERLELLSHIADSFVYVVSRMGTTGVQSSVASDLDELISRVRKYTKDTPLAVGFGVSTREHFQSVGSVADGVVIGSKIVTLCGDAPEGKRYDVAKEYVQGILNGAKHKVLSKDEFFAFQKESLKSANVKKEILDEFDENHKHPIRFGDFGGQYVPEALHACLRELEKGFDEAVADPTFWEDFKSLYSYIGRPSSLHKAERLTEHCQGAQIWLKREDLNHTGSHKINNALAQVLLAKRLGKKNVIAETGAGQHGVATATACAKFGLTCTVFMGAEDVRRQALNVFRMRILGAKVIAVTNGTKTLRDATSEAFRFWVTNLKTTYYVVGSAIGPHPYPTLVRTFQSVIGKETKEQFAAMNNGKLPDAVVACVGGGSNSTGMFSPFEHDTSVKLLGVEAGGDGVDTKFHSATLTAGRPGVFHGVKTYVLQDSDGQVHDTHSVSAGLDYPGVGPELAYWKSTGRAQFIAATDAQALLGFKLLSQLEGIIPALESSHAVYGACELAKTMKPDQHLVINISGRGDKDVQSVAEVLPKLGPKIGWDLRFEEDPSA

SEQ ID NO: 289 - protein, 542 aa, Saccharomyces cerevisiae
  misc_feature (0)...(0): Polypeptide Accession Number YGL028C
MISPISFLSSLLCLTYLTSALPILPKREVVTRVHTASTTNVVTDFYSTTTEVVIAPTVEFLISDSVTFTTTLIPQGVNPTAEPTTTITKVLLKKAEMSTSSQPTSTLQPSTIPQSTSSFQAESTLQAVSTQQTAMSVSAGTSEDVQQLATTSTSISSSPSPTTTSTSTQNIVSGVGEANVEGNTQSQHHSYQAAATSTLNQQTSTSIASQESTESTNTPTSSSTSSSTSSSTSSSTSSSTSSSTSSSTSSSTSSSTSSTQETAATTSEGSSSSSAAITSSPKAIAYSPYNDDGSCKSADAVSSDLTLIKSKGISKIRVYGTDCNSFETVQPAAVKLGIKINQGLYITSSGVDSIDDSVTTLIQYGQTNGWDVFDFITVGNEAINNGWCSVSDLISKISSVKSKLSEAGYSGQITTSEPPVSFENNPDLCKKSDIDFVGINPHAYFDTSASAETAGTFVKGQVELIQGVCGTSNVFVTETGYPSSGIQNGGNIPSTANQITAVQNILNEMDLDVTILSTYNDYWKAPGDYGIEQSFGVIEYFP

SEQ ID NO: 290 - protein, 105 aa, Saccharomyces cerevisiae
  misc_feature (0)...(0): Polypeptide Accession Number YGL030W
MAPVKSQESINQKLALVIKSGKYTLGYKSTVKSLRQGKSKLIIIAANTPVLRKSELEYYAMLSKTKVYYFQGGNNELGTAVGKLFRVGVVSILEAGDSDILTTLA

SEQ ID NO: 291 - protein, 234 aa, Saccharomyces cerevisiae
  misc_feature (0)...(0): Polypeptide Accession Number YGL051W
MQTPLESTDVKLDTLNEPSAHLIEKNVALPKDIFRSYLSYWIYEIARYTPVMILSLVIGVLVLLIIFFNDNEACVFNSAYYAYLSLVVLLIILGDGNPKLVSRRNFRTELLVDVITRKPAVEGKEWRIITYNMNQYLFNHGQWHTPYYFYSDEDCYRYFLRLVEGVTPKKQTATSIGNSPVTAKPEDAIESASPSSRLNYRNFLLKAAEIERQAQENYWRRRHPNIDALLKKTE

SEQ ID NO: 292 - protein, 172 aa, Saccharomyces cerevisiae
  misc_feature (0)...(0): Polypeptide Accession Number YGL058W
MSTPARRRLMRDFKRMKEDAPPGVSASPLPDNVMVWNAMIIGPADTPYEDGTFRLLLEFDEEYPNKPPHVKFLSEMFHPNVYANGEICLDILQNRWTPTYDVASILTSIQSLFNDPNPASPANVEAATLFKDHKSQYVKRVKETVEKSWEDDMDDMDDDDDDDDDDDDDEAD

SEQ ID NO: 293 - protein, 247 aa, Saccharomyces cerevisiae
  misc_feature (0)...(0): Polypeptide Accession Number YGL061C
MSEQSQLDDSTIDKLIPQIFNEMRSNLNNTTNKFPKSTGGGASDNISANSNSIRSFNSITTQSLLKESESLDKITAMIKNVTAALKNNLPVYVNQVHEVCKSTNSILDSWINIHSQAGYIHKLMSDQTYLKLINDRLHNENVNTNDEDGSTLHNVIALKKKEILDLRQKLENRKGEKDAAPAKPPNQGLNPRYGVQSGRRPVPSAGISNNGRVRKTHVPASKRPSGIPRVTNRWTKPTASSSRKMFR

SEQ ID NO: 294 - protein, 690 aa, Saccharomyces cerevisiae
  misc_feature (0)...(0): Polypeptide Accession Number YGL071W
MEGFNPADIEHASPINSSDSHSSSFVYALPKSASEYVVNHNEGRASASGNPAAVPSPIMTLNLKSTHSLNIDQHVHTSTSPTETIGHIHHVEKLNQNNLIHLDPVPNFEDKSDIKPWLQKIFYPQGIELVIERSDAFKVVFKCKAAKRGRNARRKRKDKPKGQDHEDEKSKINDDELEYASPSNATVTNGPQTSPDQTSSIKPKKKRCVSRFNNCPFRVRATYSLKRKRWSIVVMDNNHSHQLKFNPDSEEYKKFKEKLRKDNDVDAIKKFDELEYRTLANLPIPTATIPCDCGLTNEIQSFNVVLPTNSNVTSSASSSTVSSISLDSSNASKRPCLPSVNNTGSINTNNVRKPKSQCKNKDTLLKRTTMQNFLTTKSRLRKTGTPTSSQHSSTAFSGYIDDPFNLNEILPLPASDFKLNTVTNLNEIDFTNIFTKSPHPHSGSTHPRQVFDQLDDCSSILFSPLTTNTNNEFEGESDDFVHSPYLNSEADFSQILSSAPPVHHDPNETHQENQDIIDRFANSSQEHNEYILQYLTHSDAANHNNIGVPNNNSHSLNTQHNVSDLGNSLLRQEALVGSSSTKIFDELKFVQNGPHGSQHPIDFQHVDHRHLSSNEPQVRSHQYGPQQQPPQQLQYHQNQPHDGHNHEQHQTVQKDMQTHESLEIMGNTLLEEFKDIKMVNGELKYVKPED

SEQ ID NO: 295 - protein, 328 aa, Saccharomyces cerevisiae
  misc_feature (0)...(0): Polypeptide Accession Number YGL091C
MTEILPHVNDEVLPAEYELNQPEPEHCPGPESDMAGKSDACGGCANKEICESLPKGPDPDIPLITDNLSGIEHKILVLSGKGGVGKSTFAAMLSWALSADEDLQVGAMDLDICGPSLPHMLGCIKETVHESNSGWTPVYVTDNLATMSIQYMLPEDDSAIIWRGSKKNLLIKKFLKDVDWDKLDYLVIDTPPGTSDEHISINKYMRESGIDGALVVTTPQEVALLDVRKEIDFCKKAGINILGLVENMSGFVCPNCKGESQIFKATTGGGEALCKELGIKFLGSVPLDPRIGKSCDMGESFLDNYPDSPASSAVLNVVEALRDAVGDV

SEQ ID NO: 296 - protein, 516 aa, Saccharomyces cerevisiae
  misc_feature (0)...(0): Polypeptide Accession Number YGL112C
MSTQQQSYTIWSPQDTVKDVAESLGLENINDDVLKALAMDVEYRILEIIEQAVKFKRHSKRDVLTTDDVSKALRVLNVEPLYGYYDGSEVNKAVSFSKVNTSGGQSVYYLDEEEVDFDRLINEPLPQVPRLPTFTTHWLAVEGVQPAIIQNPNLNDIRVSQPPFIRGAIVTALNDNSLQTPVTSTTASASVTDTGASQHLSNVKPGQNTEVKPLVKHVLSKELQIYFNKVISTLTAKSQADEAAQHMKQAALTSLRTDSGLHQLVPYFIQFIAEQITQNLSDLQLLTTILEMIYSLLSNTSIFLDPYIHSLMPSILTLLLAKKLGGSPKDDSPQEIHEFLERTNALRDFAASLLDYVLKKFPQAYKSLKPRVTRTLLKTFLDINRVFGTYYGCLKGVSVLEGESIRFFLGNLNNWARLVFNESGITLDNIEEHLNDDSNPTRTKFTKEETQILVDTVISALLVLKKDLPDLYEGKGEKVTDEDKEKLLERCGVTIGFHILKRDDAKELISAIFFGE

SEQ ID NO: 297 - protein, 322 aa, Saccharomyces cerevisiae
  misc_feature (0)...(0): Polypeptide Accession Number YGL115W
MKPTQDSQEKVSIEQQLAVESIRKFLNSKTSYDVLPVSYRLIVLDTSLLVKKSLNVLLQNSIVSAPLWDSKTSRFAGLLTTTDFINVIQYYFSNPDKFELVDKLQLDGLKDIERALGVDQLDTASIHPSRPLFEACLKMLESRSGRIPLIDQDEETHREIVVSVLTQYRILKFVALNCRETHFLKIPIGDLNIITQDNMKSCQMTTPVIDVIQMLTQGRVSSVPIIDENGYLINVYEAYDVLGLIKGGIYNDLSLSVGEALMRRSDDFEGVYTCTKNDKLSTIMDNIRKARVHRFFVVDDVGRLVGVLTLSDILKYILLGSN

SEQ ID NO: 298 - protein, 610 aa, Saccharomyces cerevisiae
  misc_feature (0)...(0): Polypeptide Accession Number YGL116W
MPESSRDKGNAAISGNRSVLSIASPTKLNILSSDWSRNQGKVSKNSLKRSSSLNIRNSKRPSLQASANSIYSRPKITIGAPPLIRRDSSFFKDEFDAKKDKATFSAYSSRSYPTIGSESVVSQTSLSQPTTSREVDEQFTVAADRYIPILQGASQNKVDPETLHEALPPPNASPISHLRAQTKIVFKQNVAEACGLDMNKRILQYMPEPPKCSSLRQKSYIMKKRTHYSYQQEQKIPDLIKLRKINTNPERILDAPGFQDDFYLNLLSWSKKNVLAIALDTALYLWNATTGDVSLLTDFENTTICSVTWSDDDCHISIGKEDGNTEIWDVETMSLIRTMRSGLGVRIGSLSWLDTLIATGSRSGEIQINDVRIKQHIVSTWAEHTGEVCGLSYKSDGLQLASGGNDNTVMIWDTRTSLPQFSKKTHTAAVKALSWCPYSPNILASGGGQTDKHIHFWNSITGARVGSINTGSQVSSLHWGQSHTSTNGGMMNKEIVATGGNPENAISVYNYETKFKVAEVVHAHEARICCSQLSPDGTTLATVGGDENLKFYKIFDPRCTGRSREDGLMDGMLGLIGKEGCRTNDKENRSKNSSEIHTRRPSSTSQYLIR

SEQ ID NO: 299 - protein, 525 aa, Saccharomyces cerevisiae
  misc_feature (0)...(0): Polypeptide Accession Number YGL122C
MSQEQYTENLKVIVAEKLAGIPNFNEDIKYVAEYIVLLIVNGGTVESVVDELASLFDSVSRDTLANVVQTAFFALEALQQGESAENIVSKIRMMNAQSLGQSDIAQQQQQQQQQQQPDIAQQQPQQQPQQQPQQQPQQQPQQQPQQQPQQQPQQQPQLQPLQPQLGTQNAMQTDAPATPSPISAFSGVVNAAAPPQFAPVDNSQRFTQRGGGAVGKNRRGGRGGNRGGRNNNSTRFNPLAKALGMAGESNMNFTPTKKEGRCRLFPHCPLGRSCPHAHPTKVCNEYPNCPKPPGTCEFLHPNEDEELMKEMERTREEFQKRKADLLAAKRKPVQTGIVLCKFGALCSNPSCPFGHPTPANEDAKVIDLMWCDKNLTCDNPECRKAHSSLSKIKEVKPISQKKAAPPPVEKSLEQCKFGTHCTNKRCKYRHARSHIMCREGANCTRIDCLFGHPINEDCRFGVNCKNIYCLFRHPPGRVLPEKKGAAPNSNVPTNERPFALPENAIIENAPPQTSFTHQEQDTEMN

SEQ ID NO: 300 - protein, 380 aa, Saccharomyces cerevisiae
  misc_feature (0)...(0): Polypeptide Accession Number YGL126W
MSSKWFNAIHLLVCPLTVLVGYLMNAYGYGAALQATLNKDGLVNAMLVKKGWFWTSLVGWWCIIRYRAVPGATGRDRRHIVQSFKRYAILTVWWYVFTQGIWFGVGPIMDLVFVYTGGHCHYDVFDDAGHVNEDFQGSVTRTNRALALIHNVLTLHGHHQEHRQQQLWDRSIGSIQGALQATQPKTPKNVTASAAAAINTFIHDQMHRWQGPLTTSAQCRRFGGHWAGGHDPSGHVFLATLMCMFLLGELRVFGRRALAHLYAQKWQLVRLVTRLFDTGPLWTWRRCGGGSMTCGARLWRAIVEPPVTCAAALLRLTRCIACDHPVIILLTLLVTWLWQLLLTAVASRFHTVREHMSGLLAAYIVTGLVYARDAAALRPV

SEQ ID NO: 301 - protein, 127 aa, Saccharomyces cerevisiae
  misc_feature (0)...(0): Polypeptide Accession Number YGL127C
MSSTNGNAPATPSSDQNPLPTRFEVELEFIQSLANIQYVTYLLTQQQIWKSPNFKNYLKYLEYWCNPPYSQCIVYPNCLFILKLLNGFMESAIVNEDGLLEGLDELPKIIQLQGPQWMNEMVERWAN

SEQ ID NO: 302 - protein, 433 aa, Saccharomyces cerevisiae
  misc_feature (0)...(0): Polypeptide Accession Number YGL134W
MDMTKNHTTDTEEFDDGDIRPVSLGIVDDYNASFELPLKPKFLQSENFSDLTSEWDQSRSNTPGLAEGKTEKAQPCGTTDSSKNRIHVEQLLESANEMNNYLAQNIENINNFQVGLLNGGKGLYSSMGDDSSACINGTNFSSTSNFELSDDELEDTTGCTSSIFDKDLFHQQNGLSIPRRRSPLFKSPTASFEIGDATDVEEQDIDDSIFSECSSITSFDMGGLHISLPHDEEEDQEKTKSESENPLLHGIPVDVEVPHISVDEALANFKETIELLLKLSGNRKCTGFNTRVEKKEYSNFYMKSKPTLSSADFLKRIQDKCEYQPTVYLVATFLIDTLFLTRDGNNILQLKLNLQEKEVHRMIIAAVRLSTKLLEDFVHSHEYFSKVCGISKRLLTKLEVSLLICVCNTKLMVSNRKLAASKLLLNELRSFCV

SEQ ID NO: 303 - protein, 701 aa, Saccharomyces cerevisiae
  misc_feature (0)...(0): Polypeptide Accession Number YGL145W
MNGIDDLLNINDRIKQVQNERNELASKLQNLKQSLASNDTEVALSEVIAQDIIEVGASVEGLEQLRAKYGDLQILNKLEKVAVQQTQMQAGVDKLDSFERQLDELAEQPPDQFTLDDVKALHSKLTSVFATVPQINNIDSQYAAYNKLKSKVTGKYNDVIIQRLATNWSNTFDQKLLEAQWDTQKFASTSVGLVKCLRENSTKLYQLSLLYLPLEEETQNGDSERPLSRSNNNQEPVLWNFKSLANNFNVRFTYHFHATSSSSKIETYFQFLNDYLAENLYKCINIFHDDCNGLTKPVIHEQFINYVLQPIRDKVRSTLFQNDLKTLIVLISQILATDKNLLNSFHYHGLGLVSLISDEVWEKWINYEVEMANRQFINITKNPEDFPKSSQNFVKLINKIYDYLEPFYDLDFDLLVRYKLMTCSLIFMNLTSSYLDYILTVDSLNETRTKEQELYQTMAKLQHVNFVYRKIKSLSSNFIFIQLTDIVNSTESKKYNSLFQNVENDYEKAMSTDMQNSIVHRIQKLLKETLRNYFKISTWSTLEMSVDENIGPSSVPSAELVNSINVLRRLINKLDSMDIPLAISLKVKNELLNVIVNYFTESILKLNKFNQNGLNQFLHDFKSLSSILSLPSHATNYKCMSLHELVKILKLKYDPNNQQFLNPEYIKTGNFTSLKEAYSIKYLKDTKIQDALYRIIYGNIL

SEQ ID NO: 304 - protein, 1489 aa, Saccharomyces cerevisiae
  misc_feature (0)...(0): Polypeptide Accession Number YGL150C
MSLAVLLNKEDKDISDFSKTTAGKSAKKNSRERVADVAPTRVLDKKQAYLSQLNSEFNRIKRRDSIEQLYQDWKFINLQEFELISEWNQQSKDWQFDNTNDSQDLHFKKLYRDMSMINKEWAEYQSFKNANLSDIINEKDADEDEEDDEDELEDGEEDMEEDEASTGRHTNGKSMRGNGIQKSRKKDAAAAAAIGKAIKDDQTHADTVVTVNGDENEDGNNGEDEDNDNDNENNNDNDNDNENENDNDSDNDDEEENGEEDEEEEEIEDLDEEDFAAFEEQDDNDDEDFNPDVEKRRKRSSSSSSSTKLSMNSLSLITSKKINKNITINSDRPKIVRELIKMCNKNKHQKIKKRRFTNCIVTDYNPIDSKLNIKITLKQYHVKRLKKLINDAKREREREEALKNNVGLDGNDLDNDEDGSESHKRRKLNNNTANGADDANKRKFNTRHGLPTYGMKMNAKEARAIQRHYDNTYTTIWKDMARKDSTKMSRLVQQIQSIRSTNFRKTSSLCAREAKKWQSKNFKQIKDFQTRARRGIREMSNFWKKNEREERDLKKKIEKEAMEQAKKEEEEKESKRQAKKLNFLLTQTELYSHFIGRKIKTNELEGNNVSSNDSESQKNIDISALAPNKNDFHAIDFDNENDEQLRLRAAENASNALAETRAKAKQFDDHANAHEEEEEEDELNFQNPTSLGEITIEQPKILACTLKEYQLKGLNWLANLYDQGINGILADEMGLGKTVQSISVLAHLAENHNIWGPFLVVTPASTLHNWVNEISKFLPQFKILPYWGNANDRKVLRKFWDRKNLRYNKNAPFHVMVTSYQMVVTDANYLQKMKWQYMILDEAQAIKSSQSSRWKNLLSFHCRNRLLLTGTPIQNSMQELWALLHFIMPSLFDSHDEFNEWFSKDIESHAEANTKLNQQQLRRLHMILKPFMLRRVKKNVQSELGDKIEIDVLCDLTQRQAKLYQVLKSQISTNYDAIENAATNDSTSNSASNSGSDQNLINAVMQFRKVCNHPDLFERADVDSPFSFTTFGKTTSMLTASVANNNSSVISNSNMNLSSMSSNNISNGKFTDLIYSSRNPIKYSLPRLIYEDLILPNYNNDVDIANKLKNVKFNIFNPSTNYELCLFLSKLTGEPSLNEFFRVSTTPLLKRVIERTNGPKNTDSLSFKTITQELLEVTRNAPSEGVMASLLNVEKHAYEREYLNCIQRGYHPNVSAPPVTIEVLGSSHVTNSINNELFDPLISQALSDIPAITQYNMHVKKGIPVEDFPKTGLFPEPLNKNFSSNISMPSMDRFITESAKLRKLDELLVKLKSEGHRVLIYFQMTKMMDLMEEYLTYRQYNHIRLDGSSKLEDRRDLVHDWQTNPEIFVFLLSTRAGGLGINLTAADTVIFYDSDWNPTIDSQAMDRAHRLGQTRQVTVYRLLVRGTIEERMRDRAKQKEQVQQVVMEGKTQEKNIKTIEVGENDSEVTREGSKSISQDGIKEAASALA

SEQ ID NO: 305 - protein, 341 aa, Saccharomyces cerevisiae
  misc_feature (0)...(0): Polypeptide Accession Number YGL153W
MSDVVSKDRKALFDSAVSFLKDESIKDAPLLKKIEFLKSKGLTEKEIEIAMKEPKKDGIVGDEVSKKIGSTENRASQDMYLYEAMPPTLPHRDWKDYFVMATATAGLLYGAYEVTRRYVIPNILPEAKSKLEGDKKEIDDQFSKIDTVLNAIEAEQAEFRKKESETLKELSDTIAELKQALVQTTRSREKIEDEFRIVKLEVVNMQNTIDKFVSDNDGMQELNNIQKEMESLKSLMNNRMESGNAQDNRLFSISPNGIPGIDTIPSASEILAKMGMQEESDKEKENGSDANKDDNAVPAWKKAREQTIDSNASIPEWQKNTAANEISVPDWQNGQVEDSIP

SEQ ID NO: 306 - protein, 272 aa, Saccharomyces cerevisiae
  misc_feature (0)...(0): Polypeptide Accession Number YGL154C
MVKTTEVVSEVSKVAGVRPWAGIFVVEIQEDILADEFTFEALMRTLPLASQARILNKKSFHDRCSNLCSQLLQLFGCSIVTGLNFQELKFDKGSFGKPFLDNNRFLPFSMTIGEQYVAMFLVKCVSTDEYQDVGIDIASPCNYGGREELELFKEVFSEREFNGLLKASDPCTIFTYLWSLKESYTKFTGTGLNTDLSLIDFGAISFFPAEGASMCITLDEVPLIFHSQWFNNEIVTICMPKSISDKINTNRPKLYNISLSTLIDYFIENDGL

SEQ ID NO: 307 - protein, 376 aa, Saccharomyces cerevisiae
  misc_feature (0)...(0): Polypeptide Accession Number YGL155W
MCQATNGPSRVVTKKHRKFFERHLQLLPSSHQGHDVNRMAIIFYSISGLSIFDVNVSAKYGDHLGWMRKHYIKTVLDDTENTVISGFVGSLVMNIPHATTINLPNTLFALLSMIMLRDYEYFETILDKRSLARFVSKCQRPDRGSFVSCLDYKTNCGSSVDSDDLRFCYIAVAILYICGCRSKEDFDEYIDTEKLLGYIMSQQCYNGAFGAHNEPHSGYTSCALSTLALLSSLEKLSDKFKEDTITWLLHRQVSSHGCMKFESELNASYDQSDDGGFQGRENKFADTCYAFWCLNSLHLLTKDWKMLCQTELVTNYLLDRTQKTLTGGFSKNDEEDADLYHSCLGSAALALIEGKFNGELCIPQEIFNDFSKRCCF

SEQ ID NO: 308 - protein, 512 aa, Saccharomyces cerevisiae
  misc_feature (0)...(0): Polypeptide Accession Number YGL158W
MSVNPEFIADGIDFYPTTPDAAYFNAADGKNKVNRINGNSENLHHSFASGCRRSSLSVDFNVTSSDSEKSEQSCLENNSQEDEYFCDIFSTELKLDETSNKSTDYSSSNHQYPEQLELHNYKLLNKIGEGAFSRVFKAVGINTDDQAPVAIKAIIKKGISSDAILKGNDRIQGSSRKKVLNEVAIHKLVSKNNPHCTKFIAFQESANYYYLVTELVTGGEIFDRIVQLTCFSEDLARHVITQVAIAIKHMHYMGIVHRDVKPENLLFEPIPFYGLDGDMQKEDEFTLGVGGGGIGLVKLMDFGLAKKLRNNTAKTPCGTIEYVASEVFTSKRYSMKVDMWSIGCVLFTLLCGYPPFYEKNEKTLLKKISRGDYEFLAPWWDNISSGAKNAVTHLLEVDPNKRYDIDDFLNDPWLNSYDCLKDSNSNSYASVQSILNDSFDERAETLHCALSCQSEKQDDTEFSRSESSEYIFMTEEDRNLRGSWIGEPKECFTLDLATSSIYRRRKNKIFFW

SEQ ID NO: 309 - protein, 310 aa, Saccharomyces cerevisiae
  misc_feature (0)...(0): Polypeptide Accession Number YGL161C
MPSNNSSFLDIDDDLEGVDDFGNEPNPFDDATVPDSPNMNNSTAGKGSEFYNTTGSKAESAPLQGQMDPPAYDQVIGQNDNDGLGRNGLRPGLINYYSKYFQIDLTQFKKRLSAVLTFRNDHNSESNEDNTDLYGAVWITATVVMINFTMSRGLNFIISDVIEGVKTGEDIDRASQFKKLLHSIWLFYGYTFGVPFITMQVLNRDEHSERNRSFKSVPELISVYGYANLIWIPVCVILNILDMSKRLRTVQAIQWAIVALGWAQSSYFLNSQISSNNNTETQSNGKFSLSIIVVVALHTLFCLLFRFIIF

SEQ ID NO: 310 - protein, 225 aa, Saccharomyces cerevisiae
  misc_feature (0)...(0): Polypeptide Accession Number YGL166W
MVVINGVKYACETCIRGHRAAQCTHTDGPLQMIRRKGRPSTTCGHCKELRRTKNFNPSGGCMCASARRPAVGSKEDETRCRCDEGEPCKCHTKRKSSRKSKGGSCHRRANDEAAHVNGLGIADLDVLLGLNGRSSDVDMTTTLPSLKPPLQNGEIKADSIDNLDLASLDPLEQSPSISMEPVSINETGSAYTTTNTALNDIDIPFSINELNELYKQVSSHNSHSQ

SEQ ID NO: 311 - protein, 413 aa, Saccharomyces cerevisiae
  misc_feature (0)...(0): Polypeptide Accession Number YGL170C
MGAGTLLNGLEKENFPNNIHSDLPAYPNMDSQEDGNTSKESKRNSPVKQKSQKDEEKSSKMGTASNIFHENKDIHERSEHTDDFNDGLKLAPDSSPSLKECQFKNWESFWCNTEGYKTKHMQPFHFTSGLEEIKEPVMELNISTSPYKGQRPNSAPTEYSAATTAFTKTQLEVSFLKTNLLTYIKKEIDICLSSVPFFDDAVQMQKKFLEYRDIDLDEEYELKILGELLNDLNFFHMQENSLLNRELAVRRFSNQPESQNLPSIRDFRNPLLPIDNRPSPPLGLKRNGKSFEETYDFTSNTSNFWGEKAELQNSITGGTPYFFHPNNIHQTKPFMSFENQNELLFQRKNSDYKQHFNSGRNIHNGVESKSYRGVGLNDSYQKGYAAMTKSFGNIDLNRMPRRSNEEMYSWSRN

SEQ ID NO: 312 - protein, 472 aa, Saccharomyces cerevisiae
  misc_feature (0)...(0): Polypeptide Accession Number YGL172W
MFGLNKASSTPAGGLFGQASGASTGNANTGFSFGGTQTGQNTGPSTGGLFGAKPAGSTGGLGASFGQQQQQSQTNAFGGSATTGGGLFGNKPNNTANTGGGLFGANSNSNSGSLFGSNNAQTSRGLFGNNNTNNINNSSSGMNNASAGLFGSKPAGGTSLFGNTSTSSAPAQNQGMFGAKPAGTSLFGNNAGNTTTGGGLFGSKPTGATSLFGSSNNNNNNNNSNNIMSASGGLFGNQQQQLQQQPQMQCALQNLSQLPITPMTRISELPPQIRQEIEQLDQYIQKQVQISHHLKADTIDHDELIDSIPRDVAYLLKSESATSQYLKQDLKKISSFKSLIDEDLLDTQTFSVLLQQLLTPGSKISSNDLDKFFQKKIHLYEKKLEDYCRILSDIETAVNGIDTDLFGAPNNPNSTAITADLGSSEAENLLQLKTGLAAIVSTVIEEFTLFMDIAERIAVLHQKTKTLASLSI

SEQ ID NO: 313 - protein, 266 aa, Saccharomyces cerevisiae
  misc_feature (0)...(0): Polypeptide Accession Number YGL174W
MALHQYLSETYGPTKPKNKTKKKKKESKSDANSDKTSLIVKERLSTLQQEQEKSGVASFSKFDKQKSKNIWKNLETNELSHAITHPSASSITGNESKNDLKEIRAQEPLVTVADKSKTRKTIYRDAQGHKIQEDSKIDDSSFSRSKYEDEKAAEREQYLKNLNMGDVQKLGINVDAHDKKKNQTASSLTIEDPAITFTHDKERTVKTSLLGRKLYDKPAPENRFAIMPGSRWDGVHRSNGFEEKWFAKQNEINEKKVQSYTLQEDY

SEQ ID NO: 314 - protein, 345 aa, Saccharomyces cerevisiae
  misc_feature (0)...(0): Polypeptide Accession Number YGL175C
MVTGEENVYLKSSLSILKELSLDELLNVQYDVTTLIAKRVQALQNRNKCVLEEPNSKLAEILCHEKNAPQQSSQTSAGPGEQDSEDFILTQFDEDIKKESAEVHYRNENKHTVQLPLVTMPPNRHKRKISEFSSPLNGLNNLSDLEDCSDTVIHEKDNDKENKTRKLLGIELENPESTSPNLYKNVKDNFLFDFNTNPLTKRAWILEDFRPNEDIAPVKRGRRKLERFYAQVGKPEDSKHRSLSVVIESQNSDYEFAFDNLRNRSKSPPGFGRLDFPSTQEGNEDKKKSQEIIRRKTKYRFLMASNNKIPPYEREYVFKREQLNQIVDDGCFFWSDKLLQIYARC

SEQ ID NO: 315 - protein, 897 aa, Saccharomyces cerevisiae
  misc_feature (0)...(0): Polypeptide Accession Number YGL180W
MGDIKNKDHTTSVNHNLMASAGNYTAEKEIGKGSFATVYRGHLTSDKSQHVAIKEVSRAKLKNKKLLENLEIEIAILKKIKHPHIVGLIDCERTSTDFYLIMEYCALGDLTFLLKRRKELMENHPLLRTVFEKYPPPSENHNGLHRAFVLSYLQQLASALKFLRSKNLVHRDIKPQNLLLSTPLIGYHDSKSFHELGFVGIYNLPILKIADFGFARFLPNTSLAETLCGSPLYMAPEILNYQKYNAKADLWSVGTVVFEMCCGTPPFRASNHLELFKKIKRANDVITFPSYCNIEPELKELICSLLTFDPAQRIGFEEFFANKVVNEDLSSYELEDDLPELESKSKGIVESNMFVSEYLSKQPKSPNSNLAGHQSMADNPAELSDALKNSNILTAPAVKTDHTQAVDKKASNNKYHNSLVSDRSFEREYVVVEKKSVEVNSLADEVAQAGFNPNPIKHPTSTQNQNVLLNEQFSPNNQQYFQNQGENPRLLRATSSSSGGSDGSRRPSLVDRRLSISSLNPSNALSRALGIASTRLFGGANQQQQQQQITSSPPYSQTLLNSQLFHELTENIILRIDHLQHPETLKLDNTNIVSILESLAAKAFVVYSYAEVKFSQIVPLSTTLKGMANFENRRSMDSNAIAEEQDSDDAEEEDETLKKYKEDCLSTKTFGKGRTLSATSQLSATFNKLPRSEMILLCNEAIVLYMKALSILSKSMQVTSNWWYESQEKSCSLRVNVLVQWLREKFNECLEKADFLRLKINDLRFKHASEVAENQTLEEKGSSEEPVYLEKLLYDRALEISKMAAHMELKGENLYNCELAYATSLWMLETSLDDDDFTNAYGDYPFKTNIHLKSNDVEDKEKYHSVLDENDRIIIRKYIDSIANRLKILRQKMNHQN

SEQ ID NO: 316 - protein, 119 aa, Saccharomyces cerevisiae
  misc_feature (0)...(0): Polypeptide Accession Number YGL189C
MPKKRASNGRNKKGRGHVKPVRCVNCSKSIPKDKAIKRMAIRNIVEAAAVRDLSEASVYPEYALPKTYNKLHYCVSCAIHARIVRVRSREDRKNRAPPQRPRFNRENKVSPADAAKKAL

SEQ ID NO: 317 - protein, 600 aa, Saccharomyces cerevisiae
  misc_feature (0)...(0): Polypeptide Accession Number YGL192W
MINDKLVHFLIQNYDDILRAPLSGQLKDVYSLYISGGYDDEMQKLRNDKDEVLQFEQFWNDLQDIIFATPQSIQFDQNLLVADRPEKIVYLDVFSLKILYNKFHAFYYTLKSSSSSCEEKVSSLTTKPEADSEKDQLLGRLLGVLNWDVNVSNQGLPREQLSNRLQNLLREKPSSFQLAKERAKYTTEVIEYIPICSDYSHASLLSTSVYIVNNKIVSLQWSKISACQENHPGLIECIQSKIHFIPNIKPQTDISLGDCSYLDTCHKLNTCRYIHYLQYIPSCLQERADRETASENKRIRSNVSIPFYTLGNCSAHCIKKALPAQWIRCDVRKFDFRVLGKFSVVIADPAWNIHMNLPYGTCNDIELLGLPLHELQDEGIIFLWVTGRAIELGKESLNNWGYNVINEVSWIKTNQLGRTIVTGRTGHWLNHSKEHLLVGLKGNPKWINKHIDVDLIVSMTRETSRKPDELYGIAERLAGTHARKLEIFGRDHNTRPGWFTIGNQLTGNCIYEMDVERKYQEFMKSKTGTSHTGTKKIDKKQPSKLQQQHQQQYWNNMDMGSGKYYAEAKQNPMNQKHTPFESKQQQKQQFQTLNNLYFAQ

SEQ ID NO: 318 - protein, 261 aa, Saccharomyces cerevisiae
  misc_feature (0)...(0): Polypeptide Accession Number YGL198W
MSYGREDTTIEPDFIEPDAPLAASGGVADNIGGTMQNSGSRGTLDETVLQTLKRDVVEINSRLKQVVYPHFPSFFSPSDDGIGAADNDISANCDLWAPLAFIILYSLFVSHARSLFSSLFVSSWFILLVMALHLRLTKPHQRVSLISYISISGYCLFPQVLNALVSQILLPLAYHIGKQNRWIVRVLSLVKLVVMALCLMWSVAAVSWVTKSKTIIEIYLWHSVFFGMAGCQLFYNTSYICIKPNIHGHRIAYLASHGRKF

SEQ ID NO: 319 - protein, 1017 aa, Saccharomyces cerevisiae
  misc_feature (0)...(0): Polypeptide Accession Number YGL201C
MSSPFPADTPSSNRPSNSSPPPSSIGAGFGSSSGLDSQIGSRLHFPSSSQPHVSNSQTGPFVNDSTQFSSQRLQTDGSATNDMEGNEPARSFKSRALNHVKKVDDVTGEKVREAFEQFLEDFSVQSTDTGEVEKVYRAQIEFMKIYDLNTIYIDYQHLSMRENGALAMAISEQYYRFLAFLQKGLRRVVRKYAPELLNTSDSLKRSEGDEGQADEDEQQDDDMNGSSLPRDSGSSAAPGNGTSAMATRSITTSTSPEQTERVFQISFFNLPTVHRIRDIRSEKIGSLLSISGTVTRTSEVRPELYKASFTCDMCRAIVDNVEQSFKYTEPTFCPNPSCENRAFWTLNVTRSRFLDWQKVRIQENANEIPTGSMPRTLDVILRGDSVERAKPGDRCKFTGVEIVVPDVTQLGLPGVKPSSTLDTRGISKTTEGLNSGVTGLRSLGVRDLTYKISFLACHVISIGSNIGASSPDANSNNRETELQMAANLQANNVYQDNERDQEVFLNSLSSDEINELKEMVKDEHIYDKLVRSIAPAVFGHEAVKKGILLQMLGGVHKSTVEGIKLRGDINICVVGDPSTSKSQFLKYVVGFAPRSVYTSGKASSAAGLTAAVVRDEEGGDYTIEAGALMLADNGICCIDEFDKMDISDQVAIHEAMEQQTISIAKAGIHATLNARTSILAAANPVGGRYNRKLSLRGNLNMTAPIMSRFDLFFVILDDCNEKIDTELASHIVDLHMKRDEAIEPPFSAEQLRRYIKYARTFKPILTKEARSYLVEKYKELRKDDAQGFSRSSYRITVRQLESMIRLSEAIARANCVDEITPSFIAEAYDLLRQSIIRVDVDDVEMDEEFDNIESQSHAASGNNDDNDDGTGSGVITSEPPADIEEGQSEATARPGTSEKKKTTVTYDKYVSMMNMIVRKIAEVDREGAEELTAVDIVDWYLLQKENDLGSLAEYWEERRLAFKVIKRLVKDRILMEIHGTRHNLRDLENEENENNKTVYVIHPNCEVLDQLEPQDSS

SEQ ID NO: 320 - protein, 415 aa, Saccharomyces cerevisiae
  misc_feature (0)...(0): Polypeptide Accession Number YGL208W
MGTTTSHPAQKKQTTKKCRAPIMSDVREKPSNAQGCEPQEMDAVSKKVTELSLNKCSDSQDAGQPSREGSITKKKSTLLLRDEDEPTMPKLSVMETAVDTDSGSSSTSDDEEGDIIAQTTEPKQDASPDDDRSGHSSPREEGQQQIRAKEASGGPSEIKSSLMVPVEIRWQQGGSKVYVTGSFTKWRKMIGLIPDSDNNGSFHVKLRLLPGTHRFRFIVDNELRVSDFLPTATDQMGNFVNYIEVRQPEKNPTNEKIRSKEADSMRPPTSDRSSIALQIGKDPDDFGDGYTRFHEDLSPRPPLEYTTDIPAVFTDPSVMERYYYTLDRQQSNTDTSWLTPPQLPPQLENVILNKYYATQDQFNENNSGALPIPNHVVLNHLVTSSIKHNTLCVASIVRYKQKYVTQILYTPIESS

SEQ ID NO: 321 - protein, 162 aa, Saccharomyces cerevisiae
  misc_feature (0)...(0): Polypeptide Accession Number YGL214W
MDDVRLHAIYQDITRDYLPPASLNHLMLLSKQTQHKLSFKSAPIPDLQPFFKNFTSKTPGSAKESPCSSTAKISSSISISSQCIFNVVILSFVFTSQNLNLPSHPALHNVSPESLNDRLMTQLECANSPRLACELWVGTDKEPILSPNSVSYRVMQPNEFES

SEQ ID NO: 322 - protein, 288 aa, Saccharomyces cerevisiae
  misc_feature (0)...(0): Polypeptide Accession Number YGL221C
MSRAITRAQLDKLVRSITKFYPQKYADKSWDNTGLLIDCSTAQVTTADANAKTKVLLTVDLTKSVAQEAVDANCNVIVAYHPFIFPSWNRLSPHTNPQHETAIKLIQYGISVYCPHTAVDAARGGVNDWLVRGLNNGENVAKSYALETVSGETDDLIGYGRFVEFNKDISLEQIVKNVKRVLRVPYVQVASLAAPSAWNQLKIKKVAVCAGSGSGVFKQLKEDVDLYYTGEMSHHEVLKWKEMGKTVIVCNHSNTERGFLQDVMKGLLQDEGHEVVVSKMDCDPLTVA

SEQ ID NO: 323 - protein, 818 aa, Saccharomyces cerevisiae
  misc_feature (0)...(0): Polypeptide Accession Number YGL229C
MSLWPFGETLSHSGIDSILEEYYLIFRSLEGNETSSTDDKKNEPSMESESEFGTESRDRSDLNQSFIDRILLETALLDELNGAANDRLVDFICLGYFYDDRSQQVRHMDYLVDMLMAYLKDIDRTGYRTPFLLENSFHQTGEYEDQDDEDPMLYVNIISSIFCSKSAPIVEALVQNTPFLSSLFEVFQFENIEAENCPILAVFLKINETLLFEQTSSYLEFFKSQPNIVDKFLYHIEVSPLVEFLIKIMLTDQVESPTNIIDFLYHQDLIPKCLNLLENSKYSPGIQNSSGELLKALISISTNFKLDTLWIGPNRLTRQLASPQYVDQLINIILFQRGHAMGVAVSIIIELIRKNNSDYDEVDLLSTTIVDNPPSQRDPVYLGHLLYELTMHMEDFYALLIKLENDDDDDHDTASKALPSVKHHLLENQLHESFRPLGFERVKITELISEMLHCSNMGLMNSKRGEKIARTRDKCRDTLDQNSLEKAMKNLNINDNTITSNTLEDKCNNNDSNDSNDNQKQKKNIKKKFHDNELYSTFDTSDDNIDDDDDMSFEIPYVSETQNLKIRKNPTIGDLFKIKLHDLGFFPKFLQLFLRYPWNNFWHNIVFDIIQQIFNGRMDFSYNSFLVYSLFDFKKSTRFIPKPLYGSNQKLPVKDFHIISDFILQGHKDSFEFYEKEKTNLGYMGQLVLIAEEIAKYSKIYKTDLIAPDIYAFLQDEVWMSYSSDILNETRTMCSIILGGGQFCAESDENTNQDFLEKADMSKPAHPSTMDENEIVHEEDVKLHDKVAELIDELGQLTELDIHDKIKDVIVDHHSDLN

SEQ ID NO: 324 - protein, 147 aa, Saccharomyces cerevisiae
  misc_feature (0)...(0): Polypeptide Accession Number YGL230C
MGIITLSGNVLHLLKAYPKKGLEEVSQPEPNTANDSSTEYKGKSKDDFQMVEKSNTDERYNFTRTKKWFLLMTSEYYKLMENRLLMFCIIACSFICAIQFLFFIIYWTNIVPRKTQRAITNLNYDYLTAHLKEQCVPYAKILDQCIL

SEQ ID NO: 325 - protein, 265 aa, Saccharomyces cerevisiae
  misc_feature (0)...(0): Polypeptide Accession Number YGL237C
MSADETDAKFHPLETDLQSDTAAATSTAAASRSPSLQEKPIEMPLDMGKAPSPRGEDQRVTNEEDLFLFNRLRASQNRVMDSLEPQQQSQYTSSSVSTMEPSADFTSFSAVTTLPPPPHQQQQQQQQQQQQQQLVVQAQYTQNQPNLQSDVLGTAIAEQPFYVNAKQYYRILKRRYARAKLEEKLRISRERKPYLHESRHKHAMRRPRGEGGRFLTAAEIKAMKSKKSGASDDPDDSHEDKKITTKIIQEQPHATSTAAAADKKT

SEQ ID NO: 326 - protein, 960 aa, Saccharomyces cerevisiae
  misc_feature (0)...(0): Polypeptide Accession Number YGL238W
MSDLETVAKFLAESVIASTAKTSERNLRQLETQDGFGLTLLHVIASTNLPLSTRLAGALFFKNFIKRKWVDENGNHLLPANNVELIKKEIVPLMISLPNNLQVQIGEAISSIADSDFPDRWPTLLSDLASRLSNDDMVTNKGVLTVAHSIFKRWRPLFRSDELFLEIKLVLDVFTAPFLNLLKTVDEQITANENNKASLNILFDVLLVLIKLYYDFNCQDIPEFFEDNIQVGMGIFHKYLSYSNPLLEDPDETEHASVLIKVKSSIQELVQLYTTRYEDVFGPMINEFIQITWNLLTSISNQPKYDILVSKSLSFLTAVTRIPKYFEIFNNESAMNNITEQIILPNVTLREEDVELFEDDPIEYIRRDLEGSDTDTRRRACTDFLKELKEKNEVLVTNIFLAHMKGFVDQYMSDPSKNWKFKDLYIYLFTALAINGNITNAGVSSTNNLLNVVDFFTKEIAPDLTSNNIPHIILRVDAIKYIYTFRNQLTKAQLIELMPILATFLQTDEYVVYTYAAITIEKILTIRESNTSPAFIFHKEDISNSTEILLKNLIALILKHGSSPEKLAENEFLMRSIFRVLQTSEDSIQPLFPQLLAQFIEIVTIMAKNPSNPRFTHYTFESIGAILNYTQRQNLPLLVDSMMPTFLTVFSEDIQEFIPYVFQIIAFVVEQSATIPESIKPLAQPLLAPNVWELKGNIPAVTRLLKSFIKTDSSIFPDLVPVLGIFQRLIASKAYEVHGFDLLEHIMLLIDMNRLRPYIKQIAVLLLQRLQNSKTERYVKKLTVFFGLISNKLGSDFLIHFIDEVQDGLFQQIWGNFIITTLPTIGNLLDRKIALIGVLNMVINGQFFQSKYPTLISSTMNSIIETASSQSIANLKNDYVDLDNLEEISTFGSHFSKLVSISEKPFDPLPEIDVNNGVRLYVAEALNKYNAISGNTFLNTILPQLTQENQVKLNQLLVGN

SEQ ID NO: 327 - protein, 181 aa, Saccharomyces cerevisiae
  misc_feature (0)...(0): Polypeptide Accession Number YGL242C
MNTEGASLSEQLLDAARRNNLDLLETVFDSLDNDPEKIAKLINESKEPLGNTALHLCCKYGSWEVLDKILDQDGEIEIDPQNDVDGDTPLHVTVRYSQEEPEHGTFIARNLIEVGADPRVRNYNNQKPVDLVHGDELDELIDLLQGAELAIDSTNGSGDNNEDGEMIDDGPSDDDEEDDKK

SEQ ID NO: 328 - protein, 299 aa, Saccharomyces cerevisiae [sequence omitted]

SEQ ID NO: 329 - protein, 395 aa, Saccharomyces cerevisiae
  misc_feature (0)...(0): Polypeptide Accession Number YGR010W
MDPTKAPDFKPPQPNEELQPPPDPTHTIPKSGPIVPYVLADYNSSIDAPFNLDIYKTLSSRKKNANSSNRMDHIPLNTSDFQPLSRDVSSEEESEGQSNGIDATLQDVTMTGNLGVLKSQIADLEEVPHTIVRQARTIEDYEFPVHRLTKKLQDPEKLPLIIVACGSFSPITYLHLRMFEMALDDINEQTRFEVVGGYFSPVSDNYQKRGLAPAYHRVRMCELACERTSSWLMVDAWESLQSSYTRTAKVLDHFNHEINIKRGGIMTVDGEKMGVKIMLLAGGDLIESMGEPHVWADSDLHHILGNYGCLIVERTGSDVRSFLLSHDIMYEHRRNILIIKQLIYNDISSTKVRLFIRRGMSVQYLLPNSVIRYIQEYNLYINQSEPVKQVLDSKE

SEQ ID NO: 330 - protein, 1306 aa, Saccharomyces cerevisiae
  misc_feature (0)...(0): Polypeptide Accession Number YGR014W
MQFPFACLLSTLVISGSLARASPFDFIFGNGTQQAQSQSESQGQVSFTNEASQDSSTTSLVTAYSQGVHSHQSATIVSATISSLPSTWYDASSTSQTSVSYASQESDYAVNQNSWSASTNQLPSTSTTSYYAPTFSTSADFAASSVNAASDVSTASVPIDTSANSIPFTTTSNIETTTSAPLTSDTPLISTSTMSAADNVFSSANPISASLTTTDSSESFDQTSTAGAIPVQSSADFSSSSEILVQSSADFSSPSSPTTTDISLSAAPLQTSESSSFTTASAALPVSSTDVDGSSASPVVSMSAAGQIASSSSTDNPTMSETFSLTSTEVDGSDVSSTVSALLSAPFLQTSTSNSFSIVSPSVSFVPSQSSSDVASSSTANVVSSSFSDIPPQTSTSGSVVSVAQSASALAFQSSTEVYGASASSTMSSLLSTTSLQSTTLDSSSLASSSASSSDLTDYGVSSTASIPLLSASEQASTSSSFSVVSPSVSFVPSQSSSDVASTSAPSVVSSSFSYTSLQAGGSSMTNPSSSTIVYSSSTGSSEESAASTASATLSGSSSTYMAGNLQSQPPSTSSLLSESQATSTSAVLASSSVSTTSPYTTAGGASTEASSLISSTSAETSQVSYSQSTTALQTSSFASSSTTEGSETSSQGFSTSSVLVQMPSSISSEFSPSQTTTQMNSASSSSQYTISSTGILSQVSDTSVSYTTSSSSVSQVSDTPVSYTTSSSSVSQVSDTPVSYTTSSSSVSQVSDTPVSYTTSSSSVSQVSDTPVSYTTSSSSVSQVSDTSVPSTSSRSSVSQVSDTPVPSTSSRSSVSQTSSSLQPTTTSSQRFTISTHGALSESSSVSQQASEITSSINATASEYHSIQTTAATQSTTLSFTDANSSSASAPLEVATSTPTPSSKASSLLLTPSTSSLSQVATNTNVQTSLTTESTTVLEPSTTNSSSTFSLVTSSDNNWWIPTELITQAPEAASTASSTVGGTQTMTLPHAIAAATQVPEPEGYTLITIGFKKALNYEFVVSEPKSSAQIFGYLPEALNTPFKNVFTNITVLQIVPLQDDSLNYLVSVAEVYFPTAEIEELSNLITNSSSAFYTDGMGTAKSMAAMVDSSIPLTGLLHDSNSNSGGSSDGSSSSNSNSGSSGSGSNSNSGVSSSSGNSYQDAGTLEYSSKSNSNVSTSSKSKKKIIGLVIGVVVGGCLYILFMIFAFKYIIRRRIQSQEIIKNPEISSISSSEFGGEKNYNNEKRMSVQESITQSMRIQNWMDDSYYGHGLTNNDSTPTRHNTSSSIPKISRPIASQNSLGWNEV

SEQ ID NO: 331 - protein, 297 aa, Saccharomyces cerevisiae
  misc_feature (0)...(0): Polypeptide Accession Number YGR017W
MSHQMAPWIPMFIQSCKNNTEPFVSFQFATVDELTNKPRCRTVVFRDFLFHDKRTNVLTFNTDMRSSKITESFITPNSNNSSDSKRCETPFFEACFYFPETWEQYRFSGQCFTISKQFKKIPAEIVTKYDIFSPRFSETNDDSTDEEIDTPINDDDDDDKNNDADNNDINEDNKLIESIENDEHHEDEDDYYPQPQEWEAELLRQWSSLSRHTKSLYRKPAPGQKLTSETSKQLDKLHRGVDGAKEDAGLENFGIVCLCVDSVDFLNLKEGRGGERWIFQKTDGKDEDLWEEQEVCP

SEQ ID NO: 332 - protein, 237 aa, Saccharomyces cerevisiae [sequence omitted]

SEQ ID NO: 333 - protein, 385 aa, Saccharomyces cerevisiae
  misc_feature (0)...(0): Polypeptide Accession Number YGR046W
MLRVSENGLRFLLKCHSTNVSMFNRLLSTQIKEGRSSIDDAGIIPDGTINERPNHYIEGITKGSDLDLLEKGIRKTDEMTSNFTNYMYKFHRLPPNYGSNQLITIDKELQKELDGVMSSFKAPCRFVFGYGSGVFEQAGYSKSHSKPQIDIILGVTYPSHFHSINMRQNPQHYSSLKYFGSEFVSKFQQIGAGVYFNPFANINGHDVKYGVVSMETLLKDIATWNTFYLAGRLQKPVKILKNDLRVQYWNQLNLKAAATLAKHYTLEKNNNKFDEFQFYKEITALSYAGDIRYKLGGENPDKVNNIVTKNFERFQEYYKPIYKEVVLNDSFYLPKGFTLKNTQRLLLSRISKSSALQTIKGVFTAGITKSIKYAWAKKLKSMRRS

SEQ ID NO: 334 - protein, 1025 aa, Saccharomyces cerevisiae
  misc_feature (0)...(0): Polypeptide Accession Number YGR047C
MAAGKLKKEQQNQSAERESADTGKVNDEDEEHLYGNIDDYKHLIQDEEYDDEDVPHDLQLSEDEYNSERDSSLLAEFSDYGEISEDDEEDFMNAIREASNFKVKKKKKNDKGKSYGRQRKERVLDPEVAQLLSQANEAFVRNDLQVAERLFNEVIKKDARNFAAYETLGDIYQLQGRLNDCCNSWFLAAHLNASDWEFWKIVAILSADLDHVRQAIYCFSRVISLNPMEWESIYRRSMLYKKTGQLARALDGFQRLYMYNPYDANILRELAILYVDYDRIEDSIELYMKVFNANVERREAILAALENALDSSDEESAAEGEDADEKEPLEQDEDRQMFPDINWKKIDAKYKCIPFDWSSLNILAELFLKLAVSEVDGIKTIKKCARWIQRRESQTFWDHVPDDSEFDNRRFKNSTFDSLLAAEKEKSYNIPIDIRVRLGLLRLNTDNLVEALNHFQCLYDETFSDVADLYFEAATALTRAEKYKEAIDFFTPLLSLEEWRTTDVFKPLARCYKEIESYETAKEFYELAIKSEPDDLDIRVSLAEVYYRLNDPETFKHMLVDVVEMRKHQVDETLHRISNEKSSNDTSDISSKPLLEDSKFRTFRKKKRTPYDAERERIERERRITAKVVDKYEKMKKFELNSGLNEAKQASIWINTVSELVDIFSSVKNFFMKSRSRKFVGILRRTKKFNTELDFQIERLSKLAEGDSVFEGPLMEERVTLTSATELRGLSYEQWFELFMELSLVIAKYQSVEDGLSVVETAQEVNVFFQDPERVKMMKFVKLAIVLQMDDEEELAENLRGLLNQFQFNRKVLQVFMYSLCRGPSSLNILSSTIQQKFFLRQLKAFDSCRYNTEVNGQASITNKEVYNPNKKSSPYLYYIYAVLLYSSRGFLSALQYLTRLEEDIPDDPMVNLLMGLSHIHRAMQRLTAQRHFQIFHGLRYLYRYHKIRKSLYTDLEKQEADYNLGRAFHLIGLVSIAIEYYNRVLENYDDGKLKKHAAYNSIIIYQQSGNVELADHLMEKYLSI

SEQ ID NO: 335 - protein, 361 aa, Saccharomyces cerevisiae
  misc_feature (0)...(0): Polypeptide Accession Number YGR048W
MFSGFSSFGGGNGFVNMPQTFEEFFRCYPIAMMNDRIRKDDANFGGKIFLPPSALSKLSMLNIRYPMLFKLTANETGRVTHGGVLEFIAEEGRVYLPQWMMETLGIQPGSLLQISSTDVPLGQFVKLEPQSVDFLDISDPKAVLENVLRNFSTLTVDDVIEISYNGKTFKIKILEVKPESSSKSICVIETDLVTDFAPPVGYVEPDYKALKAQQDKEKKNSFGKGQVLDPSVLGQGSMSTRIDYAGIANSSRNKLSKFVGQGQNISGKAPKAEPKQDIKDMKITFDGEPAKLDLPEGQLFFGFPMVLPKEDEESAAGSKSSEQNFQGQGISLRKSNKRKTKSDHDSSKSKAPKSPEVIEID

SEQ ID NO: 336 - protein, 187 aa, Saccharomyces cerevisiae
  misc_feature (0)...(0): Polypeptide Accession Number YGR049W
MQVSPAIVKGIAVSSLGLYAGILTSSTVISITTPINVLTQHLKNVLCTLGCWSTVLGGLATGAFGLSYYLAAPGERPNYLLCGLGVAPLSAAYLYLVSLFNHKLAPKCTRDQNDLEKQKDEKLPQHHPEVKDGEAACPFSKMNNAKTLKPESERSVKCHSYMSLHMSIVTGITIFTFGKCILDGFKA

SEQ ID NO: 337 - protein, 245 aa, Saccharomyces cerevisiae
  misc_feature (0)...(0): Polypeptide Accession Number YGR057C
MHRMSSTVISLAHFCDKHGPRIISVTQSAEKGTLGEELLVPDYPTESYCESCLLQFPEESTRSMRCFIEDVPFITTQYSSIRYQLLNSIIKRAFSEETMIYDNMPFIFFDDLRGLNLVIGFKLYDENARGNERRYCFILTVDSRSHDDSMKMLSEHWNFIIGGFDKMIAYIKNIHKSEFLGKNKTVENNLETLNNNAFIGSYLRANKSKFGRNLVSLTDDKFLFVRIHKWNSFLLHTVMNENKLP

SEQ ID NO: 338 - protein, 335 aa, Saccharomyces cerevisiae
  misc_feature (0)...(0): Polypeptide Accession Number YGR058W
MCAKKLKYAAGDDFVRYATPKEAMEETRREFEKEKQRQQQIKVTQAQTPNTRVHSAPIPLQTQYNKNRAENGHHSYGSPQSYSPRHTKTPVDPRYNVIAQKPAGRPIPPAPTHYNNLNTSAQRIASSPPPLIHNQAVPAQLLKKVAPASFDSREDVRDMQVATQLFHNHDVKGKNRLTAEELQNLLQNDDNSHFCISSVDALINLFGASRFGTVNQAEFIALYKRVKSWRKVYVDNDINGSLTISVSEFHNSLQELGYLIPFEVSEKTFDQYAEFINRNGTGKELKFDKFVEALVWLMRLTKLFRKFDTNQEGIATIQYKDFIYATLYLGRFLPH

SEQ ID NO: 339 - protein, 1358 aa, Saccharomyces cerevisiae
  misc_feature (0)...(0): Polypeptide Accession Number YGR061C
MTDYILPGPKALSQFRVDNLIKDINSYTNSTSVINELRSCYIHYVNGIAQNLSEQDTKLLEVLLTYDSALDIANDPLARQLNDAVANNLPSSALGEDTYLIRVVPRSGTISPWSSKATNIAHVCGLQDKVQRIERGLALLIKTVPGFPLLENLNDISLKCVYDRMTQQLYLTEPPNTMSIFTHEEPKPLVHVPLTPKDTKQSPKDILSKANTELGLALDSGEMEYLIHAFVETMKRDPTDVELFMFAQVNSEHCRHKIFNADWTIDGIKQQFTLFQMIRNTHKLNPEYTISAYSDNAAVLDSENDAFFFAPNSTTKEWTSTKERIPLLIKVETHNHPTAVSPFPGAATGSGGEIRDEGATGRGSKTKCGLSGFSVSDLLIPGNEQPWELNIGKPYHIASALDIMIEAPLGSAAFNNEFGRPCINGYFRTLTTKVLNHQGKEEIRGFHKPIMIAGGFGTVRPQFALKNTPITPGSCLIVLGGQSMLIGLGGGAASSVASGEGSADLDFASVQRGNPEMERRCQQVIDACVALGNNNPIQSIHDVGAGGLSNALPELVHDNDLGAKFDIRKVLSLEPGMSPMEIWCNESQERYVLGVSPQDLSIFEEICKRERAPFAVVGHATAEQKLIVEDPLLKTTPIDLEMPILFGKPPKMSRETITEALNLPEANLSEIPSLQDAIQRVLNLPSVGSKSFLITIGDRSVTGLIDRDQFVGPWQVPVADVGVTGTSLGETIISTGEAMAMGEKPVNALISASASAKLSVAESLLNIFAADVKSLNHIKLSANWMSPASHQGEGSKLYEAVQALGLDLCPALGVAIPVGKDSMSMKMKWDDKEVTAPLSLNITAFAPVFNTSKTWTPLLNRNTDDSVLVLVDLSAKQETKSLGASALLQVYNQVGNKSPTVYDNAILKGFLESLIQLHQQKEDIVLAYHDRSDGGLLITLLEMAFASRCGLEINIDGGDLESQLTNLFNEELGAVFQISAKNLSKFEKILNENGVAKEYISIVGKPSFQSQEIKIINSTTNDVIYANSRSELEQTWSKTSYEMQKLRDNPKTAEEEFASITDDRDPGLQYALTYNPADDMKIGLELSSQRPKVAILREQGVNGQMEMAWCFQQAGFNSVDVTMTDLLEGRFHLDDFIGLAACGGFSYGDVLGAGAGWAKSVLYHEGVRSQFSKFFNERQDTFAFGACNGCQFLSRLKDIIPGCENWPSFERNVSEQYEARVCMVQISQEKDNSSEESVFLNGMAGSKLPIAVAHGEGKATFSKSAEQLEKFEKDGLCCIRYVDNYGNVTERFPFNPNGSTNGIAGIKSPNGRVLAMMPHPERVCRLEANSWYPEGKYEEWGGYGPWIRLFRSARRWVG

SEQ ID NO: 340 - protein, 586 aa, Saccharomyces cerevisiae
  misc_feature (0)...(0): Polypeptide Accession Number YGR068C
MFSLSSLSSSGGHSEQKERERISYFDIRINSPYKDIILIQGSPLELSSIPLSGNLVISVKNEIVVKKISLRLVGRFKLEFLQVGRYKKNSSSLASLVKEKRKIFECYWDNLLVSSKGDVLVGGENAENQHNSSSGRSTSNQDMDTSGNAIFLSKRSLSSPVFNKIIRRKTHSSHRKILELPENGVTGTPFEGLRENARSRSSSSNTLNNNSHSYSNRDGSGSSYLFLMKRGNYELPFNTMLPPEVCETIEGLQSGSILYSFEAIIDGRQLWDTDLSVHTSPHGPIGSTSTSGNGMRTKNKIIIKKFKYLRILRTLSMDNLAMQEEISVGNTWRDKLQYETSIPSRAVPIGSTTPVKIKIFPFEKNIRLDRIEMALIQYYAMKDSSAQIYDDEIAVMKITHLADFGPLTDKLDVDCPFTIPDNLKQITQDCCLQDNLIRVMHKLQVRILLQRQVDGEYKNLEIKAQLPMLLFISPHLPMKGRLVLFDKHDGKIHFRPGELVPLFLTTYPAQGLTPGVELNSTTTAHLALPQPPPNYHESTNDHLMPALQPLGADSVVLTVPSYEQAQAQASASSYVTGSVPAYCDDD

SEQ ID NO: 341 - protein, 242 aa, Saccharomyces cerevisiae
  misc_feature (0)...(0): Polypeptide Accession Number YGR075C
MAVNEFQVESNISPKQLNNQSVSLVIPRLTRDKIHNSMYYKVNLSNESLRGNTMVELLKVMIGAFGTIKGQNGHLHMMVLGGIEFKCILMKLIEIRPNFQQLNFLLNVKNENGFDSKYIIALLLVYARLQYYYLNGNNKNDDDENDLIKLFKVQLYKYSQHYFKLKSFPLQVDCFAHSYNEELCIIHIDELVDWLATQDHIWGIPLGKCQWNKIYNSDEESSSSESESNGDSEDDNDTSSES

SEQ ID NO: 342 - protein, 688 aa, Saccharomyces cerevisiae
  misc_feature (0)...(0): Polypeptide Accession Number YGR099W
MVLETLKQGLDSSQIHEALIQLDSYPREPVDLDASMVLIKFVIPVYPSLPERSKVILRRLASKSFTFLCQIVTFSRTISGRDGLQEIRIYQEILEDIISFEPGCLTFYLKASTTSKADRDSIKALFFGSKLFNVLANRIDMAKYLGYLRLQWKFLLESNETDPPGFLGEWLVSSFLLNPVLAADMLLGELFLLKESYFFSFQKIISASSLIDQKRLIAKFLLPYIQVIVTLENLNDVRKILRRFDLDKIISLSVLFEIQSLPLKEVIVRLMSNHSSTKFVSALVSKFADFTDEEVDTKTCELLVLFAVHNLNHSQREEIAHDERFLNGVTKHLGSNEREARERAMFIAKLLSGGHLKYESDFKINIPNVKFESNSDDKIIDFQSLKNPSICNTQTDVGKDKITEVSGHVQSLTLDCSDSDDEDENDEREIVKRIVFLKDLMKEYEKTGESRKAPLIPLLKQTVKLIRQKADFQLEVGYYAQGILSSIVCLNNEFDEPLFEQWRINALTSILVVLPEKVNGAINILFNSELSLQQRMSLLSALGLSARELRGLDDPTIVKPKFDFPTNRLPWDDQSHHNSRLVEVQESTSMIKKTKTVWKSRKLGKDREKGTQNRFRKYAGLFFYPLAHGWLNGIDVGTYNQLFKSHYLTTLRIIYSCANPVHDFESMTELMNHIISSAIEEGISLNKG

SEQ ID NO: 343 - protein, 307 aa, Saccharomyces cerevisiae
  misc_feature (0)...(0): Polypeptide Accession Number YGR104C
MVQQLSLFGSIGDDGYDLLISTLTTISGNPPLLYNSLCTVWKPNPSYDVENVNSRNQLVEPNRIKLSKEVPFSYLIDETMMDKPLNFRILKSFTNDKIPLNYAMTRNILHNTVPQVTNFNSTNEDQNNSKHTEDTVNESRNSDDIIDVDMDASPAPSNESCSPWSLQISDIPAAGNNRSVSMQTIAETIILSSAGKNSSVSSLMNGLGYVFEFQYLTIGVKFFMKHGLILELQKIWQIEEAGNSQITSGGFLLKAYINVSRGTDIDRINYTETALMNLKKELQGYIELSVPDRQSMDSRVAHGNILI

SEQ ID NO: 344 - protein, 471 aa, Saccharomyces cerevisiae
  misc_feature (0)...(0): Polypeptide Accession Number YGR108W
MSRSLLVENSRTINSNEEKGVNESQYILQKRNVPRTILGNVTNNANILQEISMNRKIGMKNFSKLNNFFPLKDDVSRADDFTSSFNDSRQGVKQEVLNNKENIPEYGYSEQEKQQCSNDDSFHTNSTALSCNRLIYSENKSISTQMEWQKKIMREDSKKKRPISTLVEQDDQKKFKLHELTTEEEVLEEYEWDDLDEEDCDDPLMVSEEVNDIFDYLHHLEIITLPNKANLYKHKNIKQNRDILVNWIIKIHNKFGLLPETLYLAINIMDRFLCEEVVQLNRLQLVGTSCLFIASKYEEIYSPSIKHFAYETDGACSVEDIKEGERFILEKLDFQISFANPMNFLRRISKADDYDIQSRTLAKFLMEISIVDFKFIGILPSLCASAAMFLSRKMLGKGTWDGNLIHYSGGYTKAKLYPVCQLLMDYLVGSTIHDEFLKKYQSRRFLKASIISIEWALKVRKNGYDIMTLHE

SEQ ID NO: 345 - protein, 335 aa, Saccharomyces cerevisiae
  misc_feature (0)...(0): Polypeptide Accession Number YGR113W
MSEDKAKLGTTRSATEYRLSIGSAPTSRRSSMGESSSLMKFADQEGLTSSVGEYNENTIQQLLLPKIRELSDSIITLDSNFTRLNFIHESLADLNESLGSLLYGIMSNSWCVEFSQAPHDIQDDLIAIKQLKSLEDEKNNLVMELSNMERGIKRKKDEQGENDLAKASQNKQFNQPLFPSSQVRKYRSYDNRDKRKPSKIGNNLQVENEEDYEDDTSSEASFVLNPTNIGMSKSSQGHVTKTTRLNNNTNSKLRRKSILHTIRNSIASGADLPIENDNVVNLGDLHPNNRIYSEVVLQEWSMGPLRRTEIQCSQDVLKGNPQKADILLQRKLKKK

SEQ ID NO: 346 - protein, 476 aa, Saccharomyces cerevisiae
  misc_feature (0)...(0): Polypeptide Accession Number YGR117C
MADNSTSRFYTNLLIANYLKHNGLEDTLAAFIRETALPLSALEKSDSSNSNVGEIPLEDLQSVVEDRIYYKRRSFKDRFKTLSINDDLAPIDNAKYGIQPWNHSLKFSIDVKLNKSLPKDTLFISATFTEDSKYILLSSATGYLVIYDIEKATSKSFKINEKVKSIVKLYGPIGSSGYQYVCPMNGSFYLLNNDFELVNNAVWKIHARMITHIKICNVTESSWFVITSGMDNFLRLSLLEIKNGNTFLTKLSEIKLASNCTSLNVIANGDGNGQNSFSVFLTRAEYTHIACYSIIDAKNLVHSYNIALNNAEFSTYAFNIRDVMAVDYVHSNTKDTIGLSPSTMLVVATSHKPYMRLILVEIPMNTGHPKAMKLDKVQTYYDKILRNFATEIYQDDFSLPILGKLESSNGVLVGNDEGIYSVDLMTGDSRILNIPGEANSLHDRIKCMDISKDQMRMVAGTSTKSIYILNVIRNAQ

SEQ ID NO: 347 - protein, 541 aa, Saccharomyces cerevisiae
  misc_feature (0)...(0): Polypeptide Accession Number YGR119C
MFGFSGSNNGFGNKPAGSTGFSFGQNNNNTNTQPSASGFGFGGSQPNSGTATTGGFGANQATNTFGSNQQSSTGGGLFGNKPALGSLGSSSTTASGTTATGTGLFGQQTAQPQQSTIGGGLFGNKPTTTTGGLFGNSAQNNSTTSGGLFGNKVGSTGSLMGGNSTQNTSNMNAGGLFGAKPQNTTATTGGLFGSKPQGSTTNGGLFGSGTQNNNTLGGGGLFGQSQQPQTNTAPGLGNTVSTQPSFAWSKPSTGSNLQQQQQQQIQVPLQQTQAIAQQQQLSNYPQQIQEQVLKCKESWDPNTTKTKLRAFVYNKVNETEAILYTKPGHVLQEEWDQAMEKKPSPQTIPIQIYGFEGLNQRNQVQTENVAQARIILNHILEKSTQLQQKHELDTASRILKAQSRNVEIEKRILKLGTQLATLKNRGLPLGIAEEKMWSQFQTLLQRSEDPAGLGKTNELWARLAILKERAKNISSQLDSKLMVFNDDTKNQDSMSKGTGEESNDRINKIVEILTNQQRGITYLNEVLEKDAAIVKKYKNKT

SEQ ID NO: 348 - protein, 275 aa, Saccharomyces cerevisiae
  misc_feature (0)...(0): Polypeptide Accession Number YGR120C
MVNSHSRNFSQGEMDFLNDDELDLDLPVTAEISKELFATEIEKYRESETNGTDVDNFDVDRFLVQKNFHYLPLDSLIRDLSGLSQKMVQTLLEQIRSNYDDYLTFSNTYTDEENETLINLEKTQSDLQKFMTQLDHLIKDDISNTQEIIKDVLEYLKKLDEIYGSLRNHSQLTEALSLGKRLSKSLHEMCGIEPLEEEICSGLIEQLYKLITASRRILESCADSNSPYIHHLRNDYQDLLQEFQISLKILTEKCLENPSSLQNLSLTLVSIIKTA

SEQ ID NO: 349 - protein, 402 aa, Saccharomyces cerevisiae
  misc_feature (0)...(0): Polypeptide Accession Number YGR122W
MRENAMSTKKLPYKLSGSSKITTSIPNDLIILRNNCINSLNSSSSKADSITCIDTWLKYTEGLLTHRYEANNDAALIEEEIAIALINVAVFYQDIGIETLYRAYESSQASNNLWTTSGTYLKRGLGLICFLGKNFQINTANDCQKMQVLNVLNQLSLEFQLLQQLGIVVLALSKLRSKISKDAVADLEPQELEELGKSSVFYAKLCIGSYSTASQCQGGRIVDALFMNYLQSLTYLFLSINQYNNDECGIAIGMLQESIKKLLNIVPNSQLKELDILSSTDITKKRDLIKMSFKRKIHGSTLKNQRIFEKKVPFSSKAYMMPLLKSSLDDFVIPLTILLRYRYQTTNENYSFKTVETDVSKLKELFPRGKSSDIEGTVWSFQDGHLTFADSNNATHNCGNYF

SEQ ID NO: 350 - protein, 215 aa, Saccharomyces cerevisiae [sequence omitted]

SEQ ID NO: 351 - protein, 241 aa, Saccharomyces cerevisiae
  misc_feature (0)...(0): Polypeptide Accession Number YGR136W
MSASLVNRSLKNIRNELEFLKESNVISGDIFELINSKLPEKWDGNQRSPQNADTEEYVEALYDFEAQQDGDLSLKTGDKIQVLEKISPDWYRGKSNNKIGIFPANYVKPAFTRSASPKSAEAASSSTVSRPSVPPPSYEPAASQYPSQQVSAPYAPPAGYMQAPPPQQQQAPLPYPPPFTNYYQQPQQQYAPPSQQAPVEAQPQQSSGASSAFKSFGSKLGNAAIFGAGSAIGSDIVNSIF

SEQ ID NO: 352 - protein, 326 aa, Saccharomyces cerevisiae
  misc_feature (0)...(0): Polypeptide Accession Number YGR144W
MSATSTATSTSASQLHLNSTPVTHCLSDIVKKEDWSDFKFAPIRESTVSRAMTSRYFKDLDKFAVSDVIIVGAGSSGLSAAYVIAKNRPDLKVCIIESSVAPGGGSWLGGQLFSAMVMRKPAHLFLQELEIPYEDEGDYVVVKHAALFISTVLSKVLQLPNVKLFNATCVEDLVTRPPTEKGEVTVAGVVTNWTLVTQAHGTQCCMDPNVIELAGYKNDGTRDLSQKHGVILSTTGHDGPFGAFCAKRIVDIDQNQKLGGMKGLDMNHAEHDVVIHSGAYAGVDNMYFAGMEVAELDGLNRMGPTFGAMALSGVHAAEQILKHFAA

SEQ ID NO: 353 - protein, 356 aa, Saccharomyces cerevisiae
  misc_feature (0)...(0): Polypeptide Accession Number YGR154C
MSVSYKGTISKTHSVFKPEKGRYYIYGALGCPFTHRAILARSLKKLEPVLGLVLSHWQLDSKGARFLPAPHRPEKYKERFFTATGGIASAKLDESEELGDVNNDSARLFVDGAFDPVENISRLSELYYLNDPKYPGTKFTVPVLWDSKTRKIVNNESGDIIRILNSGVFDEFIQSEETNVIDLVPHDLIDEIDKNIKWVHPKINLGVYKVGLAENGKIYETEVKTLFENLQKMECVLKENYKRLEEQFSGNKQKILAKYFVLGQRLTEADIRLYPSIIRFDVVYVQHFKCNLKTIRDGFPYLHLWLINLYWNYAEFRFTTDFNHIKLFYIRMEVSRNKINQFGIVPLGPKPDISRL

SEQ ID NO: 354 - protein, 507 aa, Saccharomyces cerevisiae
  misc_feature (0)...(0): Polypeptide Accession Number YGR155W
MTKSEQQADSRHNVIDLVGNTPLIALKKLPKALGIKPQIYAKLELYNPGGSIKDRIAKSMVEEAEASGRIHPSRSTLIEPTSGNTGIGLALIGAIKGYRTIITLPEKMSNEKVSVLKALGAEIIRTPTAAAWDSPESHIGVAKKLEKEIPGAVILDQYNNMMNPEAHYFGTGREIQRQLEDLNLFDNLRAVVAGAGTGGTISGISKYLKEQNDKIQIVGADPFGSILAQPENLNKTDITDYKVEGIGYDFVPQVLDRKLIDVWYKTDDKPSFKYARQLISNEGVLVGGSSGSAFTAVVKYCEDHPELTEDDVIVAIFPDSIRSYLTKFVDDEWLKKNNLWDDDVLARFDSSKLEASTTKYADVFGNATVKDLHLKPVVSVKETAKVTDVIKILKDNGFDQLPVLTEDGKLSGLVTLSELLRKLSINNSNNDNTIKGKYLDFKKLNNFNDVSSYNENKSGKKKFIKFDENSKLSDLNRFFEKNSSAVITDGLKPIHIVTKMDLLSYLA

SEQ ID NO: 355 - protein, 250 aa, Saccharomyces cerevisiae
  misc_feature (0)...(0): Polypeptide Accession Number YGR158C
MNVQDRRRLLGPAAAKPMAFSNTTTHVPEKKSTDLTPKGNESEQELSLHTGFIENCNGSALVEARSLGHQTSLITAVYGPRSIRGSFTSQGTISIQLKNGLLEKYNTNELKEVSSFLMGIFNSVVNLSRYPKSGIDIFVYLTYDKDLTNNPQDDDSQSKMMSSQISSLIPHCITSITLALADAGIELVDMAGAGEANGTVVSFIKNGEEIVGFWKDDGDDEDLLECLDRCKEQYNRYRDLMISCLMNQET

SEQ ID NO: 356 - protein, 341 aa, Saccharomyces cerevisiae
  misc_feature (0)...(0): Polypeptide Accession Number YGR163W
MSLEATDSKAMVLLMGVRRCGKSSICKVVFHNMQPLDTLYLESTSNPSLEHFSTLIDLAVMELPGQLNYFEPSYDSERLFKSVGALVYVIDSQDEYINAITNLAMIIEYAYKVNPSINIEVLIHKVDGLSEDFKVDAQRDIMQRTGEELLELGLDGVQVSFYLTSIFDHSIYEAFSRIVQKLIPELSFLENMLDNLIQHSKIEKAFLFDVNSKIYVSTDSNPVDIQMYEVCSEFIDVTIDLFDLYKAPVLRNSQKSSDKDNVINPRNELQNVSQLANGVIIYLRQMIRGLALVAIIRPNGTDMESCLTVADYNIDIFKKGLEDIWANARASQAKNSIEDDV

SEQ ID NO: 357 - protein, 368 aa, Saccharomyces cerevisiae
  misc_feature (0)...(0): Polypeptide Accession Number YGR173W
MGIIDKIKAIEEEMARTQKNKATEHHLGLLKGKLARYRQQLLADEAGSGGGGGSGFEVAKSGDARVVLIGYPSVGKSSLLGKITTTKSEIAHYAFTTLTSVPGVLKYQGAEIQIVDLPGIIYGASQGKGRGRQVVATARTADLVLMVLDATKSEHQRASLEKELENVGIRLNKEKPNIYYKKKETGGVKVTFTSPPKTNLTEQAIKMILRDYRIHNAEVLVRDDQCTIDDFIDVINEQHRNYVKCLYVYNKIDAVSLEEVDKLAREPNTVVMSCEMDLGLQDVVEEIWYQLNLSRVYTKKRGVRPVFDDPLVVRNNSTIGDLCHGIHRDFKDKFKYALVWGSSAKHSPQKCGLNHRIDDEDVVSLFAK

SEQ ID NO: 358 - protein, 317 aa, Saccharomyces cerevisiae
  misc_feature (0)...(0): Polypeptide Accession Number YGR213C
MAKDGFELYRYTPELGASILFTVLFAVSGVAFVILLFHYSVKSKRRVGSLMKSQPVLRYYGTVNLAGAYIPFIFGCFVECVGFAFRCKSSKDTTLLNPYIIQTVFLLVSPTLYAASIYMIFGRMATLLFAENLMIMPARFNTTIFVIGDVGSLLLQAIGGAMMSKVTSASSGSHLVTAGLFIQIAFFGLFIINEVLFIFKMSKKPTNVSVRYGSWKYLNIALLVNSFLILIRSIVRAVEFIQGYDGEIASHEWYLYIFDGLPMFLLVLIFIVAFPLINIFRIHEESIQAQQSARFDGTDYPDVEVTSIEEDLASKSE

SEQ ID NO: 359 - protein, 505 aa, Saccharomyces cerevisiae
  misc_feature (0)...(0): Polypeptide Accession Number YGR229C
MDLFKRKVKEWVYSLSTDDHYAEYNPDETPTFNMGKRLNSNNGQVNPSQMHLNSVDEEMSMGFQNGVPSNEDINIDEFTSTESNDGVSETLLAWRHIDFWTSEHNPDLNATLSDPCTQNDITHAEEDLEVSFPNPVKASFKIHDGQEDLESMTGTSGLFYGFQLMTLDQVVAMTQAWRNVAKNLNKRSQQGLSHVTSTGSSSSMERLNGNKFKLPNIPDQKSIPPNAVQPVYAHPAWIPLITDNAGNHIGVDLAPGPNGKYAQIITFGRDFDTKFVIAENWGEFLLSFANDLEAGNWYLVDDNDDYFSGDGELVFRDKKSNGPIQDYFEVLKRRTWIKYQENLRSQQQKSQPDTSLQEQKYVPASQKKVAAEQPSTLNAESIKGEDSGSADVQSVQDHESVKIVKTEPSEAETTTVNTESLGQAEHEIKADNVDIKQESERKEDEKQPKVEEKEHVENEHVTESAKKDDDVNKQTEEMNKKEENEIRSDDAKVEEAREEFENIAL

SEQ ID NO: 360 - protein, 228 aa, Saccharomyces cerevisiae
  misc_feature (0)...(0): Polypeptide Accession Number YGR232W
MSNYPLHQACMENEFFKVQELLHSKPSLLLQKDQDGRIPLHWSVSFQAHEITSFLLSKMENVNLDDYPDDSGWTPFHIACSVGNLEVVKSLYDRPLKPDLNKITNQGVTCLHLAVGKKWFEVSQFLIENGASVRIKDKFNQIPLHRAASVGSLKLIELLCGLGKSAVNWQDKQGWTPLFHALAEGHGDAAVLLVEKYGAEYDLVDNKGAKAEDVALNEQVKKFFLNNV

SEQ ID NO: 361 - protein, 399 aa, Saccharomyces cerevisiae [sequence omitted]

SEQ ID NO: 362 - protein, 288 aa, Saccharomyces cerevisiae
  misc_feature (0)...(0): Polypeptide Accession Number YGR239C
MPSVCHTSPIEKIIQQGHRIQNDSLIPSKRTKLAHTELTAHYATEDSHVEKHFLHNGSNFDGIDNVRYQNQPSPLTFITPNNTVDSSDWVPQFSSMKIDDSLEFSSEYKRLYSNYESQQRLNSSRQHLPFKNCMIRKTSCTYPPQKTLRQQRQGNRDNPTDAFQFDAEFQVLEREIQKERYEPITRRDEKWFDQDQSELQRIATDIVKCCTPPPSSASSSSTLSSSVESKLSESKFIQLMRNISSGDVTLKKNADGNSASELFSSNNGELVGNRHIFVKDEIHKDILD

SEQ ID NO: 363 - protein, 781 aa, Saccharomyces cerevisiae
  misc_feature (0)...(0): Polypeptide Accession Number YGR250C
MNIAEEPSDEVISSGPEDTDICSQQTSASAEAGDQSIKIERKTSTGLQLEQLANTNLLTIRIKWQLQEEEDDHCNSRITDQIMDTIQHYKGISVNNSDTETYEFLPDTRRLQVLEQNKDIYLYEHGSQEYEKSYKDNEEEDDWRYDTVLQAQFKYPKSLENACTDISELLKSEPIGQHIDKWSIGVNKHALTYPGNIFVGGIAKSLSIGELSFLFSKYGPILSMKLIYDKTKGEPNGYGFISYPLGSQASLCIKELNGRTVNGSTLFINYHVERKERERIHWDHVKENNNDDNFRCLFIGNLPYHNPEKVETLITPKEVIEVIKKELSKKFPDFDIISYYFPKRSNTRSSSSVSFNEEGSVESNKSSNNTNGNAQDEDMLKGYGFIKLINHEQALAAIETFNGFMWHGNRLVVNKAVQHKVYNNHNSHDRHPSISNHNDMEVLEFANNPMYDYNNYTYDRYYFNNNKNGNSNDTSNVRYFDSVRSTPVAEKMDLFYPQRESFSEGRGQRVPRFMGNKFDMYQYPSTSYSLPIPMSNQQESNLYVKHIPLSWTDEDLYDFYKSFGEIISVKVITVGGSKNKYRQQSNDSSSDNDLPVGSSRGYGFVSFESPLDAAKAILNTDGYQVSKDQVLSVSFAQKRGNLSSSDDDDQSQTDNSSKFQNFQPHNDYHKAYPTKYNKKFINALMTQNQSQQQVSRENYFIPLQYPNTNTKPVNSYNLISANQNNANWMMPMFPSFGFIPQVPPVPYIIPPQNPAANHIPIMANGSNEEEEFSSGDYSMDY

SEQ ID NO: 364 - protein, 439 aa, Saccharomyces cerevisiae
  misc_feature (0)...(0): Polypeptide Accession Number YGR252W
MVTKHQIEEDHLDGATTDPEVKRVKLENNVEEIQPEQAETNKQEGTDKENKGKFEKETERIGGSEVVTDVEKGIVKFEFDGVEYTFKERPSVVEENEGKIEFRVVNNDNTKENMMVLTGLKNIFQKQLPKMPKEYIARLVYDRSHLSMAVIRKPLTVVGGITYRPFDKREFAEIVFCAISSTEQVRGYGAHLMNHLKDYVRNTSNIKYFLTYADNYAIGYFKKQGFTKEITLDKSIWMGYIKDYEGGTLMQCSMLPRIRYLDAGKILLLQEAALRRKIRTISKSHIVRPGLEQFKDLNNIKPIDPMTIPGLKEAGWTPEMDALAQRPKRGPHDAAIQNILTELQNHAAAWPFLQPVNKEEVPDYYDFIKEPMDLSTMEIKLESNKYQKMEDFIYDARLVFNNCRMYNGENTSYYKYANRLEKFFNNKVKEIPEYSHLID

SEQ ID NO: 365 - protein, 260 aa, Saccharomyces cerevisiae
  misc_feature (0)...(0): Polypeptide Accession Number YGR253C
MFLTRSEYDRGVSTFSPEGRLFQVEYSLEAIKLGSTAIGIATKEGVVLGVEKRATSPLLESDSIEKIVEIDRHIGCAMSGLTADARSMIEHARTAAVTHNLYYDEDINVESLTQSVCDLALRFGEGASGEERLMSRPFGVALLIAGHDADDGYQLFHAEPSGTFYRYNAKAIGSGSEGAQAELLNEWHSSLTLKEAELLVLKILKQVMEEKLDENNAQLSCITKQDGFKIYDNEKTAELIKELKEKEAAESPEEADVEMS

SEQ ID NO: 366 - protein, 243 aa, Saccharomyces cerevisiae
  misc_feature (0)...(0): Polypeptide Accession Number YGR267C
MHNIQLVQEIERHETPLNIRPTSPYTLNPPVERDGFSWPSVGTRQRAEETEEEEKERIQRISGAIKTILTELGEDVNREGLLDTPQRYAKAMLYFTKGYQTNIMDDVIKNAVFEEDHDEMVIVRDIEIYSLCEHHLVPFFGKVHIGYIPNKKVIGLSKLARLAEMYARRLQVQERLTKQIAMALSDILKPLGVAVVMEASHMCMVSRGIQKTGSSTVTSCMLGGFRAHKTREEFLTLLGRRSI

SEQ ID NO: 367 - protein, 198 aa, Saccharomyces cerevisiae
  misc_feature (0)...(0): Polypeptide Accession Number YGR268C
MSKDTHDDELPSYEDVIKEEERLQSQPPRPPRPAANLAQGHQSRPHQRPSTMPATSSSQTYAHSHSYTPTSSQPRPPPRPQQNPSLPWTYPPRFYCSKCGNTGYKLKNGRSCKSCWRRFAPQNNVVSAPTYYTNYTMPVYTNAWQGNRPLYVQPGDPRLGGVLCGECRGSGRTRFLLDEDICPLCHGVGRIITQPQRY

SEQ ID NO: 368 - protein, 108 aa, Saccharomyces cerevisiae
  misc_feature (0)...(0): Polypeptide Accession Number YGR269W
MRVFRHNSMVYTRFMGIFWDCLVLDLKPLYSLDGSVTIKDGGGGYTVENDMFVCSALFPLLKGGKRKINGKKRLSHRENTLVVAKHQIGRQEEMAVKCQTKHTFTGLI

SEQ ID NO: 369 - protein, 577 aa, Saccharomyces cerevisiae
  misc_feature (0)...(0): Polypeptide Accession Number YGR278W
MSTATIQDEDIKFQRENWEMIRSHVSPIISNLTMDNLQESHRDLFQVNILIGRNIICKNVVDFTLNKQNGRLIPALSALIALLNSDIPDIGETLAKELMLMFVQQFNRKDYVSCGNILQCLSILFLYDVIHEIVILQILLLLLEKNSLRLVIAVMKICGWKLALVSKKTHDMIWEKLRYILQTQELSSTLRESLETLFEIRQKDYKSGSQGLFILDPTSYTVHTHSYIVSDEDEANKELGNFEKCENFNELTMAFDTLRQKLLINNTSDTNEGSNSQLQIYDMTSTNDVEFKKKIYLVLKSSLSGDEAAHKLLKLKIANNLKKSVVDIIIKSSLQESTFSKFYSILSERMITFHRSWQTAYNETFEQNYTQDIEDYETDQLRILGKFWGHLISYEFLPMDCLKIIKLTEEESCPQGRIFIKFLFQELVNELGLDELQLRLNSSKLDGMFPLEGDAEHIRYSINFFTAIGLGLLTEDMRSRLTIIQEVEDAEEEEKKLREEEELEKLRKKARESQPTQGPKIHESRLFLQKDTRENSRSRSPFTVETRKRARSRTPPRGSRNHRNRSRTPPARRQRHR

SEQ ID NO: 370 - protein, 120 aa, Saccharomyces cerevisiae
  misc_feature (0)...(0): Polypeptide Accession Number YGR294W
MVKLTSIAAGVAAIAATASATTTLAQSDERVNLVELGVYVSDIRAHLAQYYSFQAAHPTETYPVEIAEAVFNYGDFTTMLTGIAPDQVTRMITGVPWYSSRLKPAISSALSKDGIYTIAN

SEQ ID NO: 371 - protein, 452 aa, Saccharomyces cerevisiae
  misc_feature (0)...(0): Polypeptide Accession Number YHL002W
MSSSAIKIRNALLKATDPKLRSDNWQYILDVCDLVKEDPEDNGQEVMSLIEKRLEQQDANVILRTLSLTVSLAENCGSRLRQEISSKNFTSLLYALIESHSVHITLKKAVTDVVKQLSDSFKDDPSLRAMGDLYDKIKRKAPYLVQPNVPEKHNMSTQADNSDDEELQKALKMSLFEYEKQKKLQEQEKESAEVLPQQQQQHQQQNQAPAHKIPAQTVVRRVRALYDLTTNEPDELSFRKGDVITVLEQVYRDWWKGALRGNMGIFPLNYVTPIVEPSKEEIEKEKNKEAIVFSQKTTIDQLHNSLNAASKTGNSNEVLQDPHIGDMYGSVTPLRPQVTRMLGKYAKEKEDMLSLRQVLANAERSYNQLMDRAANAHISPPVPGPALYAGMTHANNTPVMPPQRQSYQSNEYSPYPSNLPIQHPTNSANNTPQYGYDLGYSVVSQPPPGYEQ

SEQ ID NO: 372 - protein, 159 aa, Saccharomyces cerevisiae
  misc_feature (0)...(0): Polypeptide Accession Number YHL006C
MQFEERLQQLVESDWSLDQSSPNVLVIVLGDTARKYVELGGLKEHVTTNTVAGHVASRERVSVVFLGRVKYLYMYLTRMQAQANGPQYSNVLVYGLWDLTATQDGPQQLRYLALCYGSASVCHLKLNSIQNRLLVACLPGYCDSGTILSDSCIVLHAIS

SEQ ID NO: 373 - protein, 330 aa, Saccharomyces cerevisiae
  misc_feature (0)...(0): Polypeptide Accession Number YHL009C
MTPSNMDDNTSGFMKFINPQCQEEDCCIRNSLFQEDSKCIKQQPDLLSEQTAPFPILEDQCPALNLDRSNNDLLLQNNISFPKGSDLQAIQLTPISGDYSTYVMADNNNNDNDSYSNTNYFSKNNGISPSSRSPSVAHNENVPDDSKAKKKAQNRAAQKAFRERKEARMKELQDKLLESERNRQSLLKEIEELRKANTEINAENRLLLRSGNENFSKDIEDDTNYKYSFPTKDEFFTSMVLESKLNHKGKYSLKDNEIMKRNTQYTDEAGRHVLTVPATWEYLYKLSEERDFDVTYVMSKLQGQECCHTHGPAYPRSLIDFLVEEATLNE

SEQ ID NO: 374 - protein, 120 aa, Saccharomyces cerevisiae
  misc_feature (0)...(0): Polypeptide Accession Number YHL018W
MHNKIVRIASSALTGGKLLEKLKPLTRWEVQWDPNKTKCLGITREVTFKDYETTWAFLTRVSMRSHLWGHHPLIHTSYTWVKLELHTHDIDPKDGAHSQLSDIDVRMAKRIDSYIDEMTT

SEQ ID NO: 375 - protein, 605 aa, Saccharomyces cerevisiae
  misc_feature (0)...(0): Polypeptide Accession Number YHL019C
MSSSLFILDENLEPLVSKNIRALPNLSSVLSSFKQCYHDGSPPILSQNDWFFIHLKRDFLHFVSVIHTTDKPNIDLMTILAFLEQFYHLLQKYFEIEVLTKNVILDNILLVLELIDECIDFGIVQVTDPSIIKDYIRVKVNVPRVTVDNEEWSPGEESSSSSGSDSDSEYSNTNKRKDKKKKRKKKKGTKGKSVGKSKLKSIMVNNKENRGINVVETVKETLRNKNDTGKEAANDELPNDGNDLYINGDIAKTIIMPISWRTKGIHYAKNEFFLDVIERVQYLMDFEKGVIRKNLIHGEIVCRCYLSGMPKLKISINKILNRDPQFMSNSSFHQCVSLDSINTIEKDEEKNSDDDAGLQAATDAREIEFIPPDGEFVLCQYELKRHVKDAPMVRLKDFEIKPKLKKFKIQIVTKIQTNFKPTNSTSKLNVRIPLTKVFQEYKIDLSKQIRFKANIGKVVFNLSDDFLLWEIQTMKGHREHSTNKSSQYNSDEDDPNTCASMVAEFPLFNQEEYDRLQEEMKTSMNPPPLRTGPRLEELYRQVHDQQTSHVTPRDKLVNIDFEIPYCTCSGLKVEYLKVEEPQLQYQSFPWVRYKTVSDEEYAYIV

SEQ ID NO: 376 - protein, 332 aa, Saccharomyces cerevisiae
  misc_feature (0)...(0): Polypeptide Accession Number YHL025W
MGVIKKKRSHHGKASRQQYYSGVQVGGVGSMGAINNNIPSLTSFAEENNYQYGYSGSSAGMNGRSLTYAQQQLNKQRQDFERVRLRPEQLSNIIHDESDTISFRSNLLKNFISSNDAFNMLSLTTVPCDRIEKSRLFSEKTIRYLMQKQHEMKTQAAELQEKPLTPLKYTKLIAAAEDGSRSTKDMIDAVFEQDSHLRYQPDGVVVHRDDPALVGKLRGDLREAPADYWTHAYRDVLAQYHEAKERIRQKEVTAGEAQDEASLQQQQQQDLQQQQQVVTTVASQSPHATATEKEPVPAVVDDPLENMFGDYSNEPFNTNFDDEFGDLDAVFF

SEQ ID NO: 377 - protein, 625 aa, Saccharomyces cerevisiae [sequence omitted]

SEQ ID NO: 378 - protein, 150 aa, Saccharomyces cerevisiae
  misc_feature (0)...(0): Polypeptide Accession Number YHL042W
MKQRFSQVATVIFFVMSIRSPRNLGFFFTLALFVVLVCSQEWFSFEMNRSCSMKVEHRMQFLSTIISEHQKSDVNCWDQIAKKMNVYLFEQKVSGSDVFFLDGADCERFFERNFLRYLPSRKSSHPDLPIAELLPYIRKADIACAGKQLI

SEQ ID NO: 379 - protein, 120 aa, Saccharomyces cerevisiae
  misc_feature (0)...(0): Polypeptide Accession Number YHL046C
MVKLTSIAAGVAAIAATASATTTLAQSDERVNLVELGVYVSDIRAHLAQYYMFQAAHPTETYPVEVAEAVFNYGDFTTMLTGIAPDQVTRMITGVPWYSSRLKPAISSALSKDGIYTITN

SEQ ID NO: 380 - protein, 291 aa, Saccharomyces cerevisiae
  misc_feature (0)...(0): Polypeptide Accession Number YHR014W
MAPRKRFRLLELGSPTHSKRKVQKPLQEKTPNLRVSPLAFKIGKEIKNKEIRKTKKTESENIFNSKHVDLRLESPHPGLNFVSDAQQYSKAGDVRYLKNKSSNTLKNERQTIERPSFDNSLRFEDIEQPPKSTSTPVLSQSSQINVEREAPMFPVPYYIAPSPMYNFSPYQNFVGNPTFLTPSHNPNLNYAIPIQRPELLYPNVNVYDSPLFKKTRLPHQTKSLDKEKNYQYLPIYPVSISNNGDFVGQETPRAAPKLSKKRLSNTLDVNCSDYESSGQNATYNDSESSLN

SEQ ID NO: 381 - protein, 468 aa, Saccharomyces cerevisiae
  misc_feature (0)...(0): Polypeptide Accession Number YHR016C
MGINNPIPRSLKSETKKAAKVLRSFVKPNQVFGADQVIPPYVLKRAKGLAIITVLKAGFLFSGRAGSGVIVARLKDGTWSAPSAIAMAGAGAGGMVGVELTDFVFILNSEEAVRSFSEFGTITLGGNVSVSAGPLGRSAEAAASASTGGVSAVFAYSKSKGLFAGVSVEGSAILERREANRKFYGDNCTSKMILSGRVKVPPAADPLLRILESRAFNFTRHDHDDNASGDDFYDDGQYSDNTSHYYDDIPDSFDSTDESSTRPNTRSSRRRGMSLGSRSRYDDDYDDDGYGRGRGYGDFDSEDEDYDYGRSPNRNSSRNRGPQIDRGTKPRANTRWEDDLYDRDTEYSRPNHSGRDYDNTRGNRRGYGRERGYSLGHGPTHPSNMSNVDDLSHKMSKTGLGNESTATNSATPTAVALYNFAGEQPGDLAFKKGDVITILKKSDSQNDWWTGRTNGKEGIFPANYVRVS

SEQ ID NO: 382 - protein, 484 aa, Saccharomyces cerevisiae
  misc_feature (0)...(0): Polypeptide Accession Number YHR030C
MADKIERHTFKVFNQDFSVDKRFQLIKEIGHGAYGIVCSARFAEAAEDTTVAIKKVTNVFSKTLLCKRSLRELKLLRHFRGHKNITCLYDMDIVFYPDGSINGLYLYEELMECDMHQIIKSGQPLTDAHYQSFTYQILCGLKYIHSADVLHRDLKPGNLLVNADCQLKICDFGLARGYSENPVENSQFLTEYVATRWYRAPEIMLSYQGYTKAIDVWSAGCILAEFLGGKPIFKGKDYVNQLNQILQVLGTPPDETLRRIGSKNVQDYIHQLGFIPKVPFVNLYPNANSQALDLLEQMLAFDPQKRITVDEALEHPYLSIWHDPADEPVCSEKFEFSFESVNDMEDLKQMVIQEVQDFRLFVRQPLLEEQRQLQLQQQQQQQQQQQQQQQQPSDVDNGNAAASEENYPKQMATSNSVAPQQESFGIHSQNLPRHDADFPPRPQESMMEMRPATGNTADIPPQNDNGTLLDLEKELEFGLDRKYF

SEQ ID NO: 383 - protein, 581 aa, Saccharomyces cerevisiae
  misc_feature (0)...(0): Polypeptide Accession Number YHR032W
MSKQFSHTTNDRRSSIIYSTSVGKAGLFTPADYIPQESEENLIEGEEQEGSEEEPSYTGNDDETEREGEYHSLLDANNSRTLQQEAWQQGYDSHDRKRLLDEERDLLIDNKLLSQHGNGGGDIESHGHGQAIGPDEEERPAEIANTWESAIESGQKISTTFKRETQVITMNALPLIFTFILQNSLSLASIFSVSHLGTKELGGVTLGSMTANITGLAAIQGLCTCLDTLCAQAYGAKNYHLVGVLVQRCAVITILAFLPMMYVWFVWSEKILALMIPERELCALAANYLRVTAFGVPGFILFECGKRFLQCQGIFHASTIVLFVCAPLNALMNYLLVWNDKIGIGYLGAPLSVVINYWLMTLGLLIYAMTTKHKERPLKCWNGIIPKEQAFKNWRKMINLAIPGVVMVEAEFLGFEVLTIFASHLGTDALGAQSIVATIASLAYQVPFSISVSTSTRVANFIGASLYDSCMITCRVSLLLSFVCSSMNMFVICRYKEQIASLFSTESAVVKMVVDTLPLLAFMQLFDAFNASTAGCLRGQGRQKNRWVHQPSRILLPRCAHGICVSIPVSSGCRRLMVGYN

SEQ ID NO: 384 - protein, 630 aa, Saccharomyces cerevisiae
  misc_feature (0)...(0): Polypeptide Accession Number YHR035W
MCSPTNFLYEPFSSDAVTQNYDQNLKCTKCGAYYSMACSLREQNVWTCLFCNQSNSNAELPLVPSNTYTLTSAKKEILSRRTIMIIDAICDPHELNYLVSILCNNYITRQQEPLSIITIQQSGHVILHNAVNHRRDAVFSINEFMTKYNLDKLNASYFEKKISEINQESYWFDKSTQGSLRKLLREICKIANKVNISSKRDKRCTGLALFVSSVLASQCSLSAYCHIVSFLNGPCTKGGGKVMSRERGESMRQNHHFESKSSQLQLSKSPTKFYKKMLEKFANQSLIYEFFIASLDQIGILEMSPLITSSMAVSQFDSFNDERFAMSFQKYLNLRDHNAIYNCHSKIMTAKNAIVVKDFPKYSLNPKNLSLPLEISLGHNSAEAPIQFQTTFENQTEKYIRIETLLLPKANRSFGAQNEIVFSMKKIASRIIDSFAYSSKHTKELMKQLFLLPNQIRGKDVDMVNLIQWCYHIYRSPILSVRNTSPDERYLFLHRIINASKDTCLSLCKPFIWSYSDLKHDWIVLDVPLTRAQILQDDKTTICVDGGSYLVLRRGKLLEKEGRELCCKLLNDLQRFPQPLYVETKTGGSQDRFLKSKIIPLDITDKETLGTEDMTFNEYFNLFTDLSGSK

SEQ ID NO: 385 - protein, 644 aa, Saccharomyces cerevisiae
  misc_feature (0)...(0): Polypeptide Accession Number YHR039C
MSKVYLNSDMINHLNSTVQAYFNLWLEKQNAIMRSQPQIIQDNQKLIGITTLVASIFTLYVLVKIISTPAKCSSSYKPVKFSLPAPEAAQNNWKGKRSVSTNIWNPEEPNFIQCHCPATGQYLGSFPSKTEADIDEMVSKAGKAQSTWGNSDFSRRLRVLASLHDYILNNQDLIARVACRDSGKTMLDASMGEILVTLEKIQWTIKHGQRALQPSRRPGPTNFFMKWYKGAEIRYEPLGVISSIVSWNYPFHNLLGPIIAALFTGNAIVVKCSEQVVWSSEFFVELIRKCLEACDEDPDLVQLCYCLPPTENDDSANYFTSHPGFKHITFIGSQPVAHYILKCAAKSLTPVVVELGGKDAFIVLDSAKNLDALSSIIMRGTFQSSGQNCIGIERVIVSKENYDDLVKILNDRMTANPLRQGSDIDHLENVDMGAMISDNRFDELEALVKDAVAKGARLLQGGSRFKHPKYPQGHYFQPTLLVDVTPEMKIAQNEVFGPILVMMKAKNTDHCVQLANSAPFGLGGSVFGADIKECNYVANSLQTGNVAINDFATFYVCQLPFGGINGSGYGKFGGEEGLLGLCNAKSVCFDTLPFVSTQIPKPLDYPIRNNAKAWNFVKSFIVGAYTNSTWQRIKSLFSLAKEAS

SEQ ID NO: 386 - protein, 205 aa, Saccharomyces cerevisiae
  misc_feature (0)...(0): Polypeptide Accession Number YHR057C
MKFSGLWCWLLLFLSVNVIASDVGELIDQDDEVITQKVFFDIEHGEEKVGRIVIGLYGKVCPKTAKNFYKLSTTTNSKKGFIGSTFHRVIPNFMVQGGDFTDGTGVGGKSIYGDTFPDENFTLKHDRKGRLSMANRGKDTNGSQFFITTTEEASWLDGKHVVFGQVVDGMDVVNYIQHVSRDANDKPLEAVKIAKCGEWTPELSS

SEQ ID NO: 387 - protein, 181 aa, Saccharomyces cerevisiae
  misc_feature (0)...(0): Polypeptide Accession Number YHR060W
MSETRMAQNMDTTDEQYLRLIELLSNYDSTLEQLQKGFQDGYIQLSRSNYYNKDSLRGNYGEDYWDETYIGQLMATVEEKNSKVVVEIVKRKAQDKQEKKEEEDNKLTQRKKGTKPEKQKTQSHKLKQDYDPILMFGGVLSVPSSLRQSQTSFKGCIPLIAQLINYKNEILTLVETLSEQE

SEQ ID NO: 388 - protein, 688 aa, Saccharomyces cerevisiae
  misc_feature (0)...(0): Polypeptide Accession Number YHR084W
MKVQITNSRTEEILKVQANNENDEVSKATPGEVEESLRLIGDLKFFLATAPVNWQENQIIRRYYLNSGQGFVSCVFWNNLYYITGTDIVKCCLYRMQKFGREVVQKKKFEEGIFSDLRNLKCGIDATLEQPKSEFLSFLFRNMCLKTQKKQKVFFWFSVAHDKLFADALERDLKRESLNQPSTTKPVNEPALSFSYDSSSDKPLYDQLLQHLDSRRPSSTTKSDNSPPKLESENFKDNELVTVTNQPLLGVGLMDDDAPESPSQINDFIPQKLIIEPNTLELNGLTEETPHDLPKNTAKGRDEEDFPLDYFPVSVEYPTEENAFDPFPPQAFTPAAPSMPISYDNVNERDSMPVNSLLNRYPYQLSVAPTFPVPPSSSRQHFMTNRDFYSSNNNKEKLVSPSDPTSYMKYDEPVMDFDESRPNENCTNAKSHNSGQQTKQHQLYSNNFQQSYPNGMVPGYYPKMPYNPMGGDPLLDQAFYGADDFFFPPEGCDNNMLYPQTATSWNVLPPQAMQPAPTYVGRPYTPNYRSTPGSAMFPYMQSSNSMQWNTAVSPYSSRAPSTTAKNYPPSTFYSQNINQYPRRRTVGMKSSQGNVPTGNKQSVGKSAKISKPLHIKTSAYQKQYKINLETKARPSAGDEDSAHPDKNKEISMPTPDSNTLVVQSEEGGAHSLEVDTNRRSDKNLPDAT

SEQ ID NO: 389 - protein, 643 aa, Saccharomyces cerevisiae
  misc_feature (0)...(0): Polypeptide Accession Number YHR091C
MFGIVYLKNRSLLCKNPFSSYPRYGFMPSFDTQFSNQFRKLEINIGRKRYSSKTLNTKYTDQPEGPIYPLDVLRLDISKALHDISGIDHSLILNALESTNSMDRGDLLLPLPKIKVADPVAVANRWAIELSTHGCIGKVCAKGPFLQFFLDQRYLIQSTVPNILLQKGKYGQKKSRHQKKVVVEFSSPNIAKPFHAGHLRSTIIGGFLSNLYEAMGWSVTRMNYLGDWGRQFGLLAVGFKRYGDEKTLQKQPIQHLFDVYVKINMDLAKEEINGNSKCGISGEARSFFKNLENGDENAIKIWNRFRSLSIHHYIQTYSRLNINFDIFSGESQVSKESMNEALDIFRKNNLVKEIDGALVIDLTQWSKRLGRVVVQKSDGTTLYLTRDVGAAIERKKNLHFDKMVYVISSQQDLYMSQFFMILKKMNFEWAKDLQHINFGMVQGMSTRKGNVVFLDTILDEARDKALQIMENNKMKISQVDNPQRVADLIGVSAIIIQDMKSKRINNYEFNWNRMLSFEGDTGPYLQYTHSRLRSLERTSSDFTTDMLIHADFSNLNEPQLVELVRLLAQYPDVLRRAFETQEPATIVTYLFKVCHQVSSCYKKIWVSGKPADIAIPRLAVYSASRQVLHNAMSLLGLVPVDRM

SEQ ID NO: 390 - protein, 1080 aa, Saccharomyces cerevisiae
  misc_feature (0)...(0): Polypeptide Accession Number YHR102W
MTTKPQNSKQGLAEGEMDVSSLFKRTEVIGRGKFGVVYKGYNVKTGRVYAIKVLNLDSDSDEVEDVQREIQFLASLKQISNITRYYGSYLKDTSLWIIMEHCAGGSLRSLLRPGKIDEKYIGVIMRELLVALKCIHKDNVIHRDIKAANVLITNEGNVKLCDFGVAAQVNQTSLRRQTMAGTPYWMAPEVIMEGVYYDTKVDIWSLGITTYEIATGNPPYCDVEALRAMQLIIKSKPPRLEDRSYSTSLKEFIALCLDEDPKERLSADDLLKSKFIRAHKATPTSILKELISRYLLFRDKNKNKYKIEGSIPENEPSKPSEAPKPSQNGGGDEAQKSIASNDNEIKRVNEGDVEMKWDFDSLSSSDYIIENNINLDALAEDNNEWATAQHDLFNYAYPDEDSYYFDPTSHNTRPFVYQGTTIGKGYPGTIAQNSTLNAPVTNNYTNSKYPSKMVAGTTNTSGTHTAGPMTSSKRLESKAPKQLLELFEDNEIITAENDVNTEAPKISKSISSLNAGNSSRDDFIPSISNEVNGNINNNKMRPHLPPLSSGNNYYSQSTPALPLLQTKFNKTSKGPPTSGLTTAPTSIEIEIPEELPNSALPTPASADPVLIPSTKARSSTVTAGTPSSSSSIQYKSPSNVPRRLTVSNNRPEHCPSTITNQKLGSAVASNSGISSTPNNSNNYNNNTDSENSRGSSGSNTANSTQMGITNPGNVTKLSTHKASSPSRPLFGVGTSPNRKPAGSPTQNIGHNSTHTNLAPPPTMKPMANSKDNKDILLQPLNSIPSSSTLNTISGNSSNNLTSSNYFSNEKEGSRVNGDFKRNNPNLKLQMPLPTPVVRNKLLDPNTATSQNNNGMPGSAGISTNENINQFGFNTSSASNIPVSMTPISEKHIDFGGKIKRSQSISNRKNSSASEHPLNILGSSVSGNVSGIGNNNVGSNNNSGPNNSVPLSANTGNTTIKANSTTIATSSSAAASTTAPISQQTIPSGTQFNHILSSAATAANSVNSLGFGMCPPPQSLQMEMFLDLESFLPGKQRRVDRKPQVLKELENLLQMFEEGLPCIEHALKEQLISTPIKDNEH

SEQ ID NO: 391 - protein, 440 aa, Saccharomyces cerevisiae
  misc_feature (0)...(0): Polypeptide Accession Number YHR111W
MNDYHLEDTTSELEALRLENAQLREQLAKREDSSRDYPLSLEEYQRYGRQMIVEETGGVAGQVKLKNTKVLVVGAGGLGCPALPYLAGAGVGQIGIVDNDVVETSNLHRQVLHDSSRVGMLKCESARQYITKLNPHINVVTYPVRLNSSNAFDIFKGYNYILDCTDSPLTRYLVSDVAVNLGITVVSASGLGTEGQLTILNFNNIGPCYRCFYPTPPPPNAVTSCQEGGVIGPCIGLVGTMMAVETLKLILGIYTNENFSPFLMLYSGFPQQSLRTFKMRGRQEKCLCCGKNRTITKEAIEKGEINYELFCGARNYNVCEPDERISVDAFQRIYKDDEFLAKHIFLDVRPSHHYEISHFPEAVNIPIKNLRDMNGDLKKLQEKLPSVEKDSNIVILCRYGNDSQLATRLLKDKFGFSNVRDVRGGYFKYIDDIDQTIPKY

SEQ ID NO: 392 - protein, 416 aa, Saccharomyces cerevisiae
  misc_feature (0)...(0): Polypeptide Accession Number YHR115C
MSTNTVPSSPPNQTPPAASGIATSHDHTKFNNPIRLPISISLTINDTPNNNSNNNSVSNGLGILPSRTATSLVVANNGSANGNVGATAAAAATVETNTAPAVNTTKSIRHFIYPPNQVNQTEFSLDIHLPPNTSLPERIDQSTLKRRMDKHGLFSIRLTPFIDTSSTSVANQGLFFDPIIRTAGAGSQIIIGRYTERVREAISKIPDQYHPVVFKSKVISRTHGCFKVDDQGNWFLKDVKSSSGTFLNHQRLSSASTTSKDYLLHDGDIIQLGMDFRGGTEEIYRCVKMKIELNKSWKLKANAFNKEALSRIKNLQKLTTGLEQEDCSICLNKIKPCQAIFISPCAHSWHFHCVRRLVIMNYPQFMCPNCRTNCDLETTLESESESEFENEDEDEPDIEMDIDMEINNNLGVRLVD

SEQ ID NO: 393 - protein, 231 aa, Saccharomyces cerevisiae
  misc_feature (0)...(0): Polypeptide Accession Number YHR122W
MSEFLNENPDILEENQLPTRKEDSTKDLLLGGFSNEATLERRSLLLKIDHSLKSQVLQDIEVLDKLLSIRIPPELTSDEDSLPAESEDESVAGGGKEEEEPDLIDAQEIYDLIAHISDPEHPLSLGQLSVVNLEDIDVHDSGNQNEMAEVVIKITPTITHCSLATLIGLGIRVRLERSLPPRFRITILLKKGTHDSENQVNKQLNDKERVAAACENEQLLGVVSKMLVTCK

SEQ ID NO: 394 - protein, 251 aa, Saccharomyces cerevisiae
  misc_feature (0)...(0): Polypeptide Accession Number YHR128W
MNPLFFLASPFLYLTYLIYYPNKGSFVSKPRNLQKMSSEPFKNVYLLPQTNQLLGLYTIIRNKNTTRPDFIFYSDRIIRLLVEEGLNHLPVQKQIVETDTNENFEGVSFMGKICGVSIVRAGESMEQGLRDCCRSVRIGKILIQRDEETALPKLFYEKLPEDISERYVFLLDPMLATGGSAIMATEVLIKRGVKPERIYFLNLICSKEGIEKYHAAFPEVRIVTGALDRGLDENKYLVPGLGDFGDRYYCV

SEQ ID NO: 395 - protein, 384 aa, Saccharomyces cerevisiae
  misc_feature (0)...(0): Polypeptide Accession Number YHR129C
MDQLSDSYALYNQPVVIDNGSGIIKAGFSGEERPKALEYCLVGNTKYDKVMLEGLQGDTFIGNNAQKLRGLLKLRYPIKHGVVEDWDSMELIWSYVLNEVLQLQNIGEHPLLITEAPMNPLKNREQMAQVLFETFDVSALYVSNPAVLSLYASGRTTGCVVDCGEGYCSTVPIYDGFALPASMMRMDIGGADITEQLQFQLRKSAGVSLFSSSEREIVRTMKEKVCYLAKNIKKEEEKYLQGTQDLISTFKLPDGRCIEVGNDRYRAPEILFSPQIIGLGYDGLSDMCMQSIWKVDLDLRKPLLSSIILSGGTTTLKGFGDRMLWDLEALTKGTSKIKIIAPSERKYTTWIGGSILTGLSTFQRLWTKKSDWLEDSTRVYSNLM

SEQ ID NO: 396 - protein, 269 aa, Saccharomyces cerevisiae
  misc_feature (0)...(0): Polypeptide Accession Number YHR134W
MKTEGIKSPSAKYHDMAGSQRIPHKNPHIQKVAVLQSKPNKEDALNLIKEIAHKVSYLMKENHFKVTNLVEFYPRDQRLLGMNVNHGSKIMLRLRCSTDEFQFLPMECIMGTMLHELTHNLFGPHDKKFYNKLDELIGRQWVIEQRGLYDTFLGNGQRLGGRANLRSNRYPMTGISTNTGIVRKRGKGVKLGSLHPEGISSIDRGNSPRELAAFAAERRYRDDRWCGETKNNKDQIISDNISSSLEVVILDDDDEVLPGDTLIEVIDLT

SEQ ID NO: 397 - protein, 239 aa, Saccharomyces cerevisiae
  misc_feature (0)...(0): Polypeptide Accession Number YHR140W
MMSCLVPTRFTLTLNTACLLTSTWGFVRATSVVLPPSLSKAGHKQFLTIISIIATIINNAVNISNYYIQRNNKMNLETKKKSDFISRHVTLPVSLVLESIVATVYWPLRLFFVNLIMHGVESTAKTPFPMTVDMAIHLYPILYLLADHYLSGSGTKFKLSNKHAWLIVTSLAFSYFQYLAFLIDAGQGQAYPYPFLDVNEPYKSIIFVVVATITWAYYVFYQKFPPKYIKKSAKKGDKN

SEQ ID NO: 398 - protein, 118 aa, Saccharomyces cerevisiae
  misc_feature (0)...(0): Polypeptide Accession Number YHR145C
MMIIIFIELCRIADSLLWIPKSSRRTSSTFYIPNIIALLKMESQQLSQNSPTLQKDILLKKSTKRNQQLRIIIFLFLPSSSYFAILHPVASLRCSRLFLCLHSLILYLEHQQIHGRVV

SEQ ID NO: 399 - protein, 1164 aa, Saccharomyces cerevisiae
  misc_feature (0)...(0): Polypeptide Accession Number YHR158C
MAGFSFAKKFTHKKHGKTPSDASISDQSREASLSTPPNEKFFTKQETPQKGRQFSQGYHSNVNKTSSPPMFARKQVSESRIQPSAVPPQQRNVSGPSTTLHKQLSKQREYTVWNRIKLQNSPFPRYRHVASAYVTDKNQIYVIGGLHDQSVYGDTWILTAFDNATRFSTTTIDISEATPPPRVGHAAVLCGNAFVVFGGDTHKVNKEGLMDDDIYLLNINSYKWTVPAPVGPRPLGRYGHKISIIATTQMKTKLYVFGGQFDDTYFNDLAVYDLSSFRRPDSHWEFLKPRTFTPPPITNFTMISYDSKLWVFGGDTLQGLVNDVFMYDPAINDWFIIDTTGEKPPPVQEHATVVYNDLMCVVGGKDEHDAYLNSVYFLNLKSRKWFKLPVFTAGIPQGRSGHSLTLLKNDKILIMGGDKFDYARVEEYDLHTSDIDMQRGTIVYTLDLARIKDLCPGVMDVPTDTPTPRNGNLDLATPVTPTSHQTKNMNVPISAAPLASAPSPAPKDFSDADRLNREVHNRNVSTEHQNQSHPVNSESHLIAEPNILTPYVPSESSQTPVMKITSNKPFDTPTIQKEPDLSETMDPTVGNQRIPSSIYGDNLTPANQIKNNSPILETLPSNEIKTPQNGNIEEIKHLPDADEKIDSTTTFDQEINGDKLGTSSMSKVEEDGNVADEDDEIGVAQMASSPSKDQFKIKHYNESSELSQNNTEIDKLSEPVDITIKKSDTAGHDSANHVIDASDEKNVSPMGDVPTDTKNEEASVPINRDATTEVVDRALFEKLRSELQSLKELTHEKALEAGAHIKELETELWQLKSQKNSGTTKEIDELDSVRLQSKCEILEADNHSLEDKVNELEELVNSKFLDIENLNEVIQFQNEKIKSLELEPNYKEKLEELQIEHENLSRENERLKNESKQHNEDIINNVANYSSQLGSLISHWKENRANSSFLESSSSLISVSDENGEKTVGEPYGDQSRHHRVVINKLTNRLDDLLERSQELTISKEKLSSEYHALKMEHSSLSQDVLVKENEIKKIQNDYKESISSMDSASKALMVSQRELEKYKSLNKKLIDELDELKFKNGVCSENFENGLRSTEESSNNVKNSNSIRENQFNIKINDLKAELFITNQERDDLKSEVLELKKRLLNLENNTKQVNEDADSDLL

SEQ ID NO: 400 - protein, 283 aa, Saccharomyces cerevisiae
  misc_feature (0)...(0): Polypeptide Accession Number YHR160C
MNSNRCQTNEVNKFISSTEKGPFTGRDNTLSFNKIGSRLNSPPILKDKIELKFLQHSEDLNQSRSYVNIRPRTLEDQSYKFEAPNLNDNETSWAKDFRYNFPKNVEPPIENQIANLNINNGLRTSQTDFPLGFYSQKNFNIASFPVVDHQIFKTTGLEHPINSHIDSLINAEFSELEASSLEEDVHTEEENSGTSLEDEETAMKGLASDIIEFCDNNSANKDVKERLNSSKFMGLMGSISDGSIVLKKDNGTERNLQKHVGFCFQNSGNWAGLEFHDVEDRIA

SEQ ID NO: 401 - protein, 518 aa, Saccharomyces cerevisiae
  misc_feature (0)...(0): Polypeptide Accession Number YHR170W
MEFTPIDPHQHQNAATLLCCNCGTPIDGSTGLVMCYDCIKLTVDITQGIPREANISFCRNCERFLQPPGQWIRAELESRELLAICLRRLKGLTKVRLVDASFIWTEPHSRRIRIKLTVQGEAMTNTIIQQTFEVEYIVIAMQCPDCARSYTTNTWRATVQIRQKVPHKRTFLFLEQLILKHNAHVDTISISEAKDGLDFFYAQKNHAVKMIDFLNAVVPIKHKKSEELISQDTHTGASTYKFSYSVEIVPICKDDLVVLPKKLAKSMGNISQFVLCSKISNTVQFMDPTTLQTADLSPSVYWRAPFNALADVTQLVEFIVLDVDSTGISRGNRVLADITVARTSDLGVNDQVYYVRSHLGGICHAGDSVMGYFIANSNYNSDLFDGLNIDYVPDVVLVKKLYQRKSKKSRHWKLKRMAKEHKDIDASLDYNSRAQKQEMERAEKDYELFLQELEEDAELRQSVNLYKNREANVPPEEHEMDEDEDEDAPQINIDELLDELDEMTLEDGVENTPVESQQ

SEQ ID NO: 402 - protein, 630 aa, Saccharomyces cerevisiae
  misc_feature (0)...(0): Polypeptide Accession Number YHR171W
MSSERVLSYAPAFKSFLDTSFFQELSRLKLDVLKLDSTCQPLTVNLDLHNIPKSADQVPLFLTNRSFEKHNNKRTNEVPLQGSIFNFNVLDEFKNLDKQLFLHQRALECWEDGIKDINKCVSFVIISFADLKKYRFYYWLGVPCFQRPSSTVLHVRPEPSLKGLFSKCQKWFDVNYSKWVCILDADDEIVNYDKCIIRKTKVLAIRDTSTMENVPSALTKNFLSVLQYDVPDLIDFKLLIIRQNEGSFALNATFASIDPQSSSSNPDMKVSGWERNVQGKLAPRVVDLSSLLDPLKIADQSVDLNLKLMKWRILPDLNLDIIKNTKVLLLGAGTLGCYVSRALIAWGVRKITFVDNGTVSYSNPVRQALYNFEDCGKPKAELAAASLKRIFPLMDATGVKLSIPMIGHKLVNEEAQHKDFDRLRALIKEHDIIFLLVDSRESRWLPSLLSNIENKTVINAALGFDSYLVMRHGNRDEQSSKQLGCYFCHDVVAPTDSLTDRTLDQMCTVTRPGVAMMASSLAVELMTSLLQTKYSGSETTVLGDIPHQIRGFLHNFSILKLETPAYEHCPACSPKVIEAFTDLGWEFVKKALEHPLYLEEISGLSVIKQEVERLGNDVFEWEDDESDEIA

SEQ ID NO: 403 - protein, 571 aa, Saccharomyces cerevisiae
  misc_feature (0)...(0): Polypeptide Accession Number YHR184W
MRSSGTYENDPSGEITSTSPKQSKQKKPTKFRERMRRWLQNGKNNNHQGEEDVPEIFNKNFYPQTGMTAFNNNDNGEVQDVTNNFFLPSEDESGPVQSSVKTFLTGNNDEDSNFQQNQNPKQKSELPKSPYRQKPTQEIALLKDLFVTNKYDDPYLNSSTRFGNITSTFPSSLSLRTVTLQTIKKRIDCISAKKKEVWKTEEKFLKDILMWLQSSNFEDPDTISLIHEIEKIFEEDIHFEQNVSDCLKEISNNFEYICMRETQLINEGNILKNDLKKYAKAREHKGEKHEDTEVLREKVISSQKSFDVTKRHYKHAISITTRQLFMNLAFEYYENCSDMKDISRKYLQESLSTLQTIDTLSFSEELEKIRKRRFDKFWAKTNPDPTNNIQKFVNMRTGVAGFNDSLMNHLYGKLSFGVAPVEEELQNSQPEHTDVPENVWNEVLSDYNSMDGNPITSNKFLSAKELEPDQLVELLAQEKEEKEAKNISSSTAEVPSISQPEIKKENLESNDSLILRSTKRNVNVNAASLRNLSIKKTQVKPESASEESKVLAAALNDAKQNLDENVWRTPI

SEQ ID NO: 404 - protein, 237 aa, Saccharomyces cerevisiae
  misc_feature (0)...(0): Polypeptide Accession Number YHR185C
MNQGYTQLSAPELKETKTSKLNKMNNFRSSPIAEIINKIPPDCGKIQNTTFPEFNPALRRRQHEQWPAYEKPIRVTDSMSPQLSSINCLPNLYPHGTLPLPNPYLSYLNHIEKVNCQDVKFSNWSVLHNSNNGFEIPTYFSPRTTQNMPCSEKVESWLERLPIFVGFDGYLFTNCFDYEYMLDWEETEFTFEKTSCMETDYSKALTDTDIIYIQEKKIEALIRNQYLKEYEFSQKDF

SEQ ID NO: 405 - protein, 309 aa, Saccharomyces cerevisiae
  misc_feature (0)...(0): Polypeptide Accession Number YHR187W
MASSSHNPVILLKRILSLTESSPFILCLDSIAQTSYKLIQEFVHQSKSKGNEYPIVYISFETVNKPSYCTQFIDATQMDFVHLVKQIISYLPAATATQAKKHMVIIDSLNYISTEYITRFLSEIASPHCTMVATYHKDIKDENRTVIPDWNNNYPDKLTLLQFMATTIVDIDVVLTGTLDTEEVSELLNEFRIPRGLNNDIFQLRLVNKRKSGRSLEYDFIVNSNTHEYELLSTTKQEEESSSNGLETPEMLQGLTTFNLGTSNKQKLAKDQVALPFLEAQSFGQGGAIVYEYEKDDDYDEEDPYEDPF

SEQ ID NO: 406 - protein, 174 aa, Saccharomyces cerevisiae
  misc_feature (0)...(0): Polypeptide Accession Number YHR193C
MSAIPENANVTVLNKNEKKARELIGKLGLKQIPGIIRVTFRKKDNQIYAIEKPEVFRSAGGNYVVFGEAKVDNFTQKLAAAQQQAQASGIMPSNEDVATKSPEDIQADMQAAAEGSVNAAAEEDDEEGEVDAGDLNKDDIELVVQQTNVSKNQAIKALKAHNGDLVNAIMSLSK

SEQ ID NO: 407 - protein, 796 aa, Saccharomyces cerevisiae
  misc_feature (0)...(0): Polypeptide Accession Number YHR204W
MVCCLWVLLALLLHLDHVACEDDAYSFTSKELKAYKQEVKELFYFGFDNYLEHGYPYDEVKPISCVPKKRNFEDPTDQGTNDILGNFTITLIDSLTTIAILEDRPQFLKAVRLVERTFPDGNFDIDSTIQVFEITIRVIGSLLSSHLYATDPTKAVYLGDDYDGSLLRLAQNMADRLLPAYLTSTGLPMPRRNIKRKWDVSEFPEFLETENNVAAMASPMFEFTILSYLTGDPKYEKVTRYAFDKTWSLRTGLDLLPMSFHPEKLTPYTPMTGIGASIDSLFEYALKGAILFDDSELMEVWNVAYEALKTNCKNDWFFANVMADTGHLFVPWIDSLSAFFSGLQVLAGDLDDAIANHLMFLKMWNTFGGIPERWNFSPPEFPPLSPLERSGAVALDNILPLEWYPLRPEFFESTYFLYRATKDPFYLNIGVHLLKDLKQRFKSNCGFAGFQNVITGELQDRMETFVLSETLKYLYLLFDEENELHNSASDVIFSTEAHPMWLPQEVRSNYKRNAKFNNSVYSSHLEICQKKDREQAGENTLSQRIVGFAKSIFHKGPPDEEATDPIIDYTIDTELPGTCSIKPHHVIGDEFWYSPMLSNFDRLFEIDSRFAATLIKPSHMHNYNAIELEPGFYNRWSNPQFSTCLIPPTTEIFELLFDLPGYHQLNPLMLENKTITFETFGGRSRLKIEKLQIYQIDYYGDLITASTFQDVSRKDIFSNACDAVASLYSPTYLYRVVAINGRILPRHGSVQIKKHSPVLTSNGTREEDEFKMDGIGINDHSQLMLECTPIINLFIV

SEQ ID NO: 408 - protein, 526 aa, Saccharomyces cerevisiae
  misc_feature (0)...(0): Polypeptide Accession Number YHR207C
MTLTIKIGTLNDSDQSAVHNGTENGSDFRKITPTEEEICDDVVLLWKEEPGTEDATIQHLYDRITERNQSWKLSASRFRKILNEHHLYDTDLETVSLYKDKIHFPKALDSDAKVEVKFIDDEHGRGLFAKRDFSKGQIILKENKPIVYIPPLDKLFLISNGKACARCGKALYDLTQHKIMVHYLDCEVCKAIWCSEKCKKAHASLHELLYHSWRSNRIDILHAGNWKRFVNYCEKYCFTAAFSVGLIYGSMLLDTTGEVKEQWQKLASISQRERIKLRDASGIGSTFSLLNGTTVHTEEESDNGTKKGVEKNIDDETVWEKCYELFCGAFPKASEEIDFEKFLTMIGTFNINQYNGQVYHWISFINHDCEPNAYIEQVEEHEELRLHARKPIKKGEQIRITYVNPLHGVRLRRRELRVNWGFLCQCDRCQNELSTFERVPNLEKKNADANLGVEKIDSNDSSEDGSKKSTGNRKSSMREAQPDLKEILKNGKEFELDIPETVDTQGNVRKTSVRFDSNVSVAVDER

SEQ ID NO: 409 - protein, 467 aa, Saccharomyces cerevisiae
  misc_feature (0)...(0): Polypeptide Accession Number YHR215W
MLKSAVYSILAASLVNAGTIPLGKLSDIDKIGTQTEIFPFLGGSGPYYSFPGDYGISRDLPESCEMKQVQMVGRHGERYPTVSKAKSIMTTWYKLSNYTGQFSGALSFLNDDYEFFIRDTKNLEMETTLANSVNVLNPYTGEMNAKRHARDFLAQYGYMVENQTSFAVFTSNSNRCHDTAQYFIDGLGDKFNISLQTISEAESAGANTLSAHHSCPAWDDDVNDDILKKYDTKYLSGIAKRLNKENKGLNLTSSDANTFFAWCAYEINARGYSDICNIFTKDELVRFSYGQDLETYYQTGPGYDVVRSVGANLFNASVKLLKESEVQDQKVWLSFTHDTDILNYLTTIGIIDDQNNLTAEHVPFMENTFHRSWYVPQGARVYTEKFQCSNDTYVRYVINDAVVPIETCSTGPGFSCEINDFYGYAEKRVAGTDFLKVCNVSSVSNSTELTFFWDWNTKHYNDTLLKQ

SEQ ID NO: 410 - protein, 220 aa, Saccharomyces cerevisiae
  misc_feature (0)...(0): Polypeptide Accession Number YIL007C
MEEEELSKLLANVKIDPSLTSRISQIDSFKLSELMVLKTDIETQLEAYFSVLEQQGIGMDSALVTPDGYPRSDVDVLQVTMIRKNVNMLKNDLNHLLQRSHVLLNQHFDNMNVKSNQDARRNNDDQAIQYTIPFAFISEVVPGSPSDKADIKVDDKLISIGNVHAANHSKLQNIQMVVMKNEDRPLPVLLLREGQILKTSLTPSRNWNGRGLLGCRIQEL

SEQ ID NO: 411 - protein, 99 aa, Saccharomyces cerevisiae
  misc_feature (0)...(0): Polypeptide Accession Number YIL008W
MVNVKVEFLGGLDAIFGKQRVHKIKMDKEDPVTVGDLIDHIVSTMINNPNDVSIFIEDDSIRPGIITLINDTDWELEGEKDYILEDGDIISFTSTLHGG

SEQ ID NO: 412 - protein, 269 aa, Saccharomyces cerevisiae
  misc_feature (0)...(0): Polypeptide Accession Number YIL011W
MSFTKIAALLAVAAASTQLVSAEVGQYEIVEFDAILADVKANLEQYMSLAMNNPDFTLPSGVLDVYQHMTTATDDSYTSYFTEMDFAQITTAMVQVPWYSSRLEPEIIAALQSAGISITSLGQTVSESGSESATASSDASSASESSSAASSSASESSSAASSSASESSSAASSSASESSSAASSSASEAAKSSSSAKSSGSSAASSAASSASSKASSAASSSAKASSSAEKSTNSSSSATSKNAGAAMDMGFFSAGVGAAIAGAAAMLL

SEQ ID NO: 413 - protein, 1411 aa, Saccharomyces cerevisiae
  misc_feature (0)...(0): Polypeptide Accession Number YIL013C
MSLSKYFNPIPDASVTFDGATVQLEESLGAVQNDEESASEFKNVGHLEISDITFRANEGEVVLVLGNPTSALFKGLFHGHKHLKYSPEGSIRFKDNEYKQFASKCPHQIIYNNEQDIHFPYLTVEQTIDFALSCKFHIPKQERIEMRDELLKEFGLSHVKKTYVGNDYVRGVSGGERKRISIIETFIANGSVYLWDNSTKGLDSATALEFLSITQKMAKATRSVNFVKISQASDKIVSKFDKILMLGDSFQVFYGTMEECLTHFHDTLQIKKNPNDCIIEYLTSILNFKFKETSNSIVGLDTPSVVSEENQALNINNETDLHTLWIQSPYYKHWKAITSKTVQECTRKDVNPDDISPIFSIPLKTQLKTCTVRAFERIIGDRNYLISQFVSVVVQSLVIGSLFYNIPLTTIGSFSRGSLTFFSILFFTFLSLADMPASFQRQPVVRKHVQLHFYYNWVETLATNFFDCCSKFILVVIFTIILYFLAHLQYNAARFFIFLLFLSVYNFCMVSLFALTALIAPTLSMANLLAGILLLAIAMYASYVIYMKDMHPWFIWIAYLNPAMFAMEAILSNELFNLKLDCHESIIPRGEYYDNISFSHKACAWQGATLGNDYVRGRDYLKSGLKYTYHHVWRNFGIIIGFLCFFLFCSLLAAEYITPLFTRENLLRWNNYLKRYCPFLNSQKKNNKSAITNNDGVCTPKTPIANFSTSSSSVPSVSHQYDTDYNIKHPDETVNNHTKESVAMETQKHVISWKNINYTIGDKKLINDASGYISSGLTALMGESGAGKTTLLNVLSQRTESGVVTGELLIDGQPLTNIDAFRRSIGFVQQQDVHLELLTVRESLEISCVLRGDGDRDYLGVVSNLLRLPSEKLVADLSPTQRKLLSIGVELVTKPSLLLFLDEPTSGLDAEAALTIVQFLKKLSMQGQAILCTIHQPSKSVISYFDNIYLLKRGGECVYFGSLPNACDYFVAHDRRLTFDREMDNPADFVIDVVGSGSTNIPMDDAEKPTSSKIDEPVSYHKQSDSINWAELWQSSPEKVRVADDLLLLEEEARKSGVDFTTSVWSPPSYMEQIKLITKRQYICTKRDMTYVFAKYALNAGAGLFIGFSFWRTKHNINGLQDAIFLCFMMLCVSSPLINQVQDKALQSKEVYIAREARSNTYHWTVLLIAQTIVELPLAISSSTLFFLCCYFCCGFETSARVAGVFYLNYILFSMYYLSFGLWLLYSAPDLQTAAVFVAFLYSFTASFCGVMQPYSLFPRFWTFMYRVSPYTYFIETFVSLLLHDREVNCSTSEMVPSQPVMGQTCGQFMKPFIDEFGGKLHINNTYTVCAYCMYTVGDDFLAQENMSYHHRWRNFGFEWVFVCFNIAAMFVGFYLTYIKKIWPSVIDGIKKCIPSMRRSKTSHNPNEQSV

SEQ ID NO: 414 - protein, 416 aa, Saccharomyces cerevisiae
  misc_feature (0)...(0): Polypeptide Accession Number YIL033C
MVSSLPKESQAELQLFQNEINAANPSDFLQFSANYFNKRLEQQRAFLKAREPEFKAKNIVLFPEPEESFSRPQSAQSQSRSRSSVMFKSPFVNEDPHSNVFKSGFNLDPHEQDTHQQAQEEQQHTREKTSTPPLPMHFNAQRRTSVSGETLQPNNFDDWTPDHYKEKSEQQLQRLEKSIRNNFLFNKLDSDSKRLVINCLEEKSVPKGATIIKQGDQGDYFYVVEKGTVDFYVNDNKVNSSGPGSSFGELALMYNSPRAATVVATSDCLLWALDRLTFRKILLGSSFKKRLMYDDLLKSMPVLKSLTTYDRAKLADALDTKIYQPGETIIREGDQGENFYLIEYGAVDVSKKGQGVINKLKDHDYFGEVALLNDLPRQATVTATKRTKVATLGKSGFQRLLGPAVDVLKLNDPTRH

SEQ ID NO: 415 - protein, 155 aa, Saccharomyces cerevisiae
  misc_feature (0)...(0): Polypeptide Accession Number YIL065C
MTKVDFWPTLKDAYEPLYPQQLEILRQQVVSEGGPTATIQSRFNYAWGLIKSTDVNDERLGVKILTDIYKEAESRRRECLYYLTIGCYKLGEYSMAKRYVDTLFEHERNNKQVGALKSMVEDKIQKETLKGVVVAGGVLAGAVAVASFFLRNKRR

SEQ ID NO: 416 - protein, 469 aa, Saccharomyces cerevisiae
  misc_feature (0)...(0): Polypeptide Accession Number YIL074C
MSYSAADNLQDSFQRAMNFSGSPGAVSTSPTQSFMNTLPRRVSITKQPKALKPFSTGDMNILLLENVNATAIKIFKDQGYQVEFHKSSLPEDELIEKIKDVHAIGIRSKTRLTEKILQHARNLVCIGCFCIGTNQVDLKYAASKGIAVFNSPFSNSRSVAELVIGEIISLARQLGDRSIELHTGTWNKVAARCWEVRGKTLGIIGYGHIGSQLSVLAEAMGLHVLYYDIVTIMALGTARQVSTLDELLNKSDFVTLHVPATPETEKMLSAPQFAAMKDGAYVINASRGTVVDIPSLIQAVKANKIAGAALDVYPHEPAKNGEGSFNDELNSWTSELVSLPNIILTPHIGGSTEEAQSSIGIEVATALSKYINEGNSVGSVNFPEVSLKSLDYDQENTVRVLYIHRNVPGVLKTVNDILSDHNIEKQFSDSHGEIAYLMADISSVNQSEIKDIYEKLNQTSAKVSIRLLY

SEQ ID NO: 417 - protein, 290 aa, Saccharomyces cerevisiae
  misc_feature (0)...(0): Polypeptide Accession Number YIL082W
MSFMDQIPGGGNYPKLPVECLPNFPIQPSLTFRGRNDSHKLKNFISEIMLNMSMISWPNDASRIVYCRRHLLNPAAQWANDFVQEQGILEITFDTFIQGLYQHFYKPPDINKIFNAITQLSEAKLGIERLNQRFRKIWDRMPPDFMTEKAAIMTYTRLLTKETYNIVRMHKPETLKDAMEEAYQTTALTERFFPGFELDADGDTIIGATTHLQEEYDSDYDSEDNLTQNRYVHTVRTRRSYNKPMSNHRNRRNNNASREECIKNRLCFYCKKEGHRLNECRARKASSNRS

SEQ ID NO: 418 - protein, 686 aa, Saccharomyces cerevisiae
  misc_feature (0)...(0): Polypeptide Accession Number YIL105C
MSKNNTMTSAVSDMLSQQQLNLQHLHNLQQHTRSMTSADHANVLQQQQQQQQQQQQQQQQQQQSASFQNGSLTSDINQQSYLNGQPVPSTSNSTFQNNRTLTMNSGGLQGIISNGSPNIDSNTNVTIAVPDPNNNNGKQLQGKNSLTNTSILSRARSSLQRQRLAQQQQQQQDPRSPLVILVPTAAQPTDILAARFSAWRNVIKSVIVYLTEIASIQDEIVRQQLRLSHAVQFPFFSIENQYQPSSQEDKSVQKFFLPLGNGSIQDLPTILNQYHESLASSASKASRELTNDVIPRLEDLRRDLIVKIKEIKSLQSDFKNSCSKELQQTKQAMKQFQESLKDARYSVPKQDPFLTKLALDRQIKKQLQEENFLHEAFDNLETSGAELEKIVVMEIQNSLTIYARLLGQEAQLVFDILISKLDSGFFNVDPQFEWDNFISRDPNFLLPNLPMRTFKEIVYKYQFDPLTYEIKSGFLERRSKFLKSYSKGYYVLTPNFLHEFKTADRKKDLVPVMSLALSECTVTEHSRKNSTSSPNSTGSDAKFVLHAKQNGIIRRGHNWVFKADSYESMMSWFDNLKILTSTSNIQDKYKFITQKLNLNSDGKPKLTNNHTSINKYQLSNANSTMVENDENDDINSNYVGSTVTPKLDNQTNTNTSMSSLPDTNDSELQDQVPNIYIQTPINDFKS

SEQ ID NO: 419 - protein, 1083 aa, Saccharomyces cerevisiae
  misc_feature (0)...(0): Polypeptide Accession Number YIL112W
MNETTTKQPLKKRSLSSYLSNVSTRREELEKISKQETSEEEDTAGKHEQRETLSEEVSDKFPENVASFRSQTTSVHQATQNNLNAKESEDLAHKNDASSHEGEVNGDSRPDDVPETNEKISQAIRAKISSSSSSPNVRNVDIQNHQPFSRDQLRAMLKEPKRKTVDDFIEEEGLGAVEEEDLSDEVLEKNTTEPENVEKDIEYSDSDKDTDDVGSDDPTAPNSPIKLGRRKLVRGDQLDATTSSMFNNESDSELSDIDDSKNIALSSSLFRGGSSPVKETNNNLSNMNSSPAQNPKRGSVSRSNDSNKSSHIAVSKRPKQKKGIYRDSGGRTRLQIACDKGKYDVVKKMIEEGGYDINDQDNAGNTALHEAALQGHIEIVELLIENGADVNIKSIEMFGDTPLIDASANGHLDVVKYLLKNGADPTIRNAKGLTAFESVDDESEFDDEEDQKILREIKKRLSIAAKKWTNRAGIHNDKSKNGNNAHTIDQPPFDNTTKAKNEKAADSPSMASNIDEKAPEEEFYWTDVTSRAGKEKLFKASKEGHLPYVGTYVENGGKIDLRSFFESVKCGHEDITSIFLAFGFPVNQTSRDNKTSALMVAVGRGHLGTVKLLLEAGADPTKRDKKGRTALYYAKNSIMGITNSEEIQLIENAINNYLKKHSEDNNDDDDDDDNNNETYKHEKKREKTQSPILASRRSATPRIEDEEDDTRMLNLADDDFNNDRDVKESTTSDSRKRLDDNENVGTQYSLDWKKRKTNALQDEEKLKSISPLSMEPHSPKKAKSVEISKIHEETAAEREARLKEEEEYRKKRLEKKRKKEQELLQKLAEDEKKRIEEQEKQKVLEMERLEKATLEKARKMEREKEMEEISYRRAVRDLYPLGLKIINFNDKLDYKRFLPLYYFVDEKNDKFVLDLQVMILLKDIDLLSKDNQPTSEKIPVDPSHLTPLWNMLKFIFLYGGSYDDKKNNMENKRYVVNFDGVDLDTKIGYELLEYKKFVSLPMAWIKWDNVVIENHAKRKEIEGNMIQISINEFARWRNDKLNKAQQPTRKQRSLKIPRELPVKFQHRMSISSVLQQTSKEPFW

SEQ ID NO: 420 - protein, 213 aa, Saccharomyces cerevisiae
  misc_feature (0)...(0): Polypeptide Accession Number YIL132C
MEYEDLELITIWPSPTKNKLCQFIKQNLSKEHVVTQLFFIDATSSFPLSQFQKLVPPTLPENVRIYENIRINTCLDLEELSAITVKLLQILSMNKINAQRGTEDAVTEPLKIILYINGLEVMFRNSQFKSSPQRSHELLRDTLLKLRVMGNDENENASIRTLLEFPKEQLLDYYLKKNNNTRTSSVRSKRRRIKNGDSLAEYIWKYYADSLFE

SEQ ID NO: 421 - protein, 691 aa, Saccharomyces cerevisiae
  misc_feature (0)...(0): Polypeptide Accession Number YIL144W
MQSSTSTDQHVLHHMDPHRFTSQIPTATSSQLRRRNSTNQGLTDMINKSIARNTISGTGIPTGGINKNKRTRSTVAGGTNGTALALNDKSNSRNSVSRLSINQLGSLQQHLSNRDPRPLRDKNFQSAIQEEIYDYLKKNKFDIETNHPISIKFLKQPTQKGFIIIFKWLYLRLDPGYGFTKSIENEIYQILKNLRYPFLESINKSQISAVGGSNWHKFLGMLHWMVRTNIKLDMCLNKVDRSLINQNTQEITILSQPLKTLDEQDQRQERYELMVEKLLIDYFTESYKSFLKLEDNYEPSMQELKLGFEKFVHIINTDIANLQTQNDNLYEKYQEVMKISQKIKTTREKWKALKSDSNKYENYVNAMKQKSQEWPGKLEKMKSECELKEEEIKALQSNISELHKILRKKGISTEQFELQNQEREKLTRELDKINIQSDKLTSSIKSRKLEAEGIFKSLLDTLRQYDSSIQNLTRSRSQLGHNVNDSSLKINISENLLDRDFHEGISYEQLFPKGSGINESIKKSILKLNDEIQERIKTIEKDNITLEKDIKNLKHDINEKTQINEKLELELSEANSKFELSKQENERLLVAQRIEIEKMEKKINDSNLLMKTKISDAEELVTSTELKLEELKVDLNRKRYKLHQQVIHVIDITSKFKINIQSSLENSENELGNVIEELRNLEFETEHNVTN

SEQ ID NO: 422 - protein, 571 aa, Saccharomyces cerevisiae
  misc_feature (0)...(0): Polypeptide Accession Number YIL150C
MNDPREILAVDPYNNITSDEEDEQAIARELEFMERKRQALVERLKRKQEFKKPQDPNFEAIEVPQSPTKNRVKVGSHNATQQGTKFEGSNINEVRLSQLQQQPKPPASTTTYFMEKFQNAKKNEDKQIAKFESMMNARVHTFSTDEKKYVPIITNELESFSNLWVKKRYIPEDDLKRALHEIKILRLGKLFAKIRPPKFQEPEYANWATVGLISHKSDIKFTSSEKPVKFFMFTITDFQHTLDVYIFGKKGVERYYNLRLGDVIAILNPEVLPWRPSGRGNFIKSFNLRISHDFKCILEIGSSRDLGWCPIVNKKTHKKCGSPINISLHKCCDYHREVQFRGTSAKRIELNGGYALGAPTKVDSQPSLYKAKGENGFNIIKGTRKRLSEEEERLKKSSHNFTNSNSAKAFFDEKFQNPDMLANLDNKRRKIIETKKSTALSRELGKIMRRRESSGLEDKSVGERQKMKRTTESALQTGLIQRLGFDPTHGKISQVLKSSVSGSEPKNNLLGKKKTVINDLLHYKKEKVILAPSKNEWFKKRSHREEVWQKHFGSKETKETSDGSASDLEII

SEQ ID NO: 423 - protein, 1118 aa, Saccharomyces cerevisiae
  misc_feature (0)...(0): Polypeptide Accession Number YIL151C
MVDLMVPANDDPSNETDYSRSNNNHTHIVSDMRPTSAAFLHQKRHSSSSHNDTPESSFAKRRVPGIVDPVGKGFIDGITNSQISAQNTPSKTDDASRRPSISRKVMESTPQVKTSSIPTMDVPKSPYYVNRTMLARNMKVVSRDTYEDNANPQMRADEPLVASNGIYSNSQPQSQVTLSDIRRAPVVAASPPPMIRQLPSAQPNQTFIKKLQEIYKIIVVQETELQQRCLYLTTSQTTELKSLWAIYRLNTELIKNYINFIITALLTTQPINDLIMGQEILDIYRIEKRLWVYGIITFLDVLKNFSNFMDPEVCCQFIIYAFISVSNMLEDIPLKYSILWRQRLGDLSRMAISLYPSGFIDWRLSAEYWYTESMKYIYGCGKLYYHIATVQQNSLEAFVNLGKSVFCQDPFTPSQQTLQLLIENIYQSAFIDRSSGSANNNEIAHRNSQLIDYLKHTEVMLLPSFLENMDLQHVVLMYFKDKFGKDFNGNDVFDTKDMFCQNPESLRYYFRHAPAFAESQLLQLIGFGNPKNPFALLFQLPKYLKLKKDKREKKRSEATETSSYTDPFDVQISSESYFQNIDALNSSFNDIPTNLNIWLDSLNHINMTSIQCSIHVLTKFLHAPLVVALPHFLTWLHFIVAILKKLEMVNSKQVVAFWIHFLRRTMPWNSIVTLGNVLVCYMLDNLHPFLKKELEKFYSLELDDLIEYYNENENLPEIWKCWGTLWFDAIKKCDVMEIPGVQDHLFFDSPLDGIVFDEKDEVGEKFWMRSVRAVLLLKGIAKKFPDLGLKVSFQASVFCRRNDIPPDYFLKNLTFKLDAYDEDNYNDNNELDDLYDTIEINEEIEAVNMDPQATPNLSVVSGESIFEYTGYTRLAPDYHCFDKNGGFNSAFIYSQWSNVGNGVTLDVSGESIYDVANNNLSLHWEKIFFDKIAAASKGSDENYNCTLYFVIDATSWLRHFAHIFKLAKNNTLKFAICLTTFQELRYLRGSKDDTVVEAATRSVITIRQLYDEKKIIPMRFTGNIATHVEENLEFEEQITWKTHVDEFVIDAIAKLNQRFQAERLTDENKNKGKEFAVLVTDDDNMNQKAKDRMIKTCNTKYLFSLGSKLGINSGLCTN

SEQ ID NO: 424 - protein, 417 aa, Saccharomyces cerevisiae
  misc_feature (0)...(0): Polypeptide Accession Number YIL160C
MSQRLQSIKDHLVESAMGKGESKRKNSLLEKRPEDVVIVAANRSAIGKGFKGAFKDVNTDYLLYNFLNEFIGRFPEPLRADLNLIEEVACGNVLNVGAGATEHRAACLASGIPYSTPFVALNRQCSSGLTAVNDIANKIKVGQIDIGLALGVESMTNNYKNVNPLGMISSEELQKNREAKKCLIPMGITNENVAANFKISRKDQDEFAANSYQKAYKAKNEGLFEDEILPIKLPDGSICQSDEGPRPNVTAESLSSIRPAFIKDRGTTTAGNASQVSDGVAGVLLARRSVANQLNLPVLGRYIDFQTVGVPPEIMGVGPAYAIPKVLEATGLQVQDIDIFEINEAFAAQALYCIHKLGIDLNKVNPRGGAIALGHPLGCTGARQVATILRELKKDQIGVVSMCIGTGMGAAAIFIKE

SEQ ID NO: 425 - protein, 117 aa, Saccharomyces cerevisiae
  misc_feature (0)...(0): Polypeptide Accession Number YIL163C
MFLFRRKDYRIEIQKKKVVKSFFQMVYYRALRQHFCQTKSFKHSSKRNVSMMVIGKHRAYLKSLRHHIKGFIITFLVSFSRNLHGKTLDVGSINATRISSPPDNFLNWVFSFYSCSE

SEQ ID NO: 426 - protein, 589 aa, Saccharomyces cerevisiae
  misc_feature (0)...(0): Polypeptide Accession Number YIL172C
MTISSAHPETEPKWWKEATIYQIYPASFKDSNNDGWGDMKGIASKLEYIKELGTDAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWRSYFGGSAWTFDEKTQEFYLRLFCSTQPDLNWENEDCRKAIYESAVGYWLDHGVDGFRIDVGSLYSKVAGLPDAPVIDENSKWQLSDPFTMNGPRIHEFHQEMNKFIRNRVKDGREIMTVGEMRHATDETKRLYTSASRHELSELFNFSHTDVGTSPKFRQNLIPYELKDWKVALAELFRYVNGTDCWSTIYLENHDQPRSITRFGDDSPKNRVISGKLLSVLLVSLSGTLYVYQGQELGEINFKNWPIEKYEDVEVRNNYDAIKEEHGENSKEMKRFLEAIALISRDHARTPMQWSREEPNAGFSGPNAKPWFYLNESFREGINAEDESKDPNSVLNFWKEALRFRKAHKDITVYGYDFEFIDLDNKKLFSFTKKYDNKTLFAALNFSSDSIDFTIPNNSSSFKLEFGNYPRSEVDASSRTLKPWEGRIYISE

SEQ ID NO: 427 - protein, 250 aa, Saccharomyces cerevisiae
  misc_feature (0)...(0): Polypeptide Accession Number YIR001C
MSQEEKVDAKATLKTEISNNKKNDKQELELDELVGKLSIEGTPQVSQKLSKEEKHAHQLEADSRSIFVGNITPDVTPEQIEDHFKDCGQIKRITLLYDRNTGTPKGYGYIEFESPAYREKALQLNGGELKGKKIAVSRKRTNIPGFNRHYNSQNQYFQQWQWNYPLMAYPNPDTFPYYPPYPPNQSPNQNFGYNKNNYYRSPYNNKNRTFQKKHFNSAKDSTKNIRSTSQKPVVMPSDNVKSSTQEKDSK

SEQ ID NO: 428 - protein, 148 aa, Saccharomyces cerevisiae
  misc_feature (0)...(0): Polypeptide Accession Number YIR005W
MNKIQQINDKELQSGILSPHQSWHNEYKDNAYIYIGNLNRELTEGDILTVFSEYGVPVDVILSRDENTGESQGFAYLKYEDQRSTILAVDNLNGFKIGGRALKIDHTFYRPKRSLQKYYEAVKEELDRDIVSKNNAEKLILAKKDQPN

SEQ ID NO: 429 - protein, 245 aa, Saccharomyces cerevisiae
  misc_feature (0)...(0): Polypeptide Accession Number YIR018W
MALPLIKPKESEESHLALLSKIHVSKNWKLPPRLPHRAAQRRKRVHRLHEDYETEENDEELQKKKRQNRDAQRAYRERKNNKLQVLEETIESLSKVVKNYETKLNRLQNELQAKESENHALKQKLETLTLKQASVPAQDPILQNLIENFKPMKAIPIKYNTAIKRHQHSTELPSSVKCGFCNDNTTCVCKELETDHRKSDDGVATEQKDMSMPHAECNNKDNPNGLCSNCTNIDKSCIDIRSIIH

SEQ ID NO: 430 - protein, 216 aa, Saccharomyces cerevisiae
  misc_feature (0)...(0): Polypeptide Accession Number YIR024C
MFMARQVLRNGLFLRSLAPIKITARTVASANAGIKRKSRFDKTMIKPLLLVMIFGSILNAVIAEKRNIIDMERKYKLKLDKLKELIRRVHDNNGKVDFDADDELKLVNLRLGIVGKNATGMKEDETDIVVPKEESLEEIWQSIIDEAKKEVIEKTPDAGVKNKEGIVTDLNVLKDLEKSKKEDEKVYLSGDVHMMMNQPGDLNEIAKEHDKIPKFL

SEQ ID NO: 431 - protein, 195 aa, Saccharomyces cerevisiae
  misc_feature (0)...(0): Polypeptide Accession Number YIR032C
MVTVVAETLTKESFEEYGTIISPDEEISRMQNLEKGANQGTAIKLLQVSQVENKSTSKVPNWNLFRCFPQPHLNRVFTQGSNQAISHSIKVLEKHPCSTQTFVPMGRTSAEVAYLVVVAKEIGNKPDLSTLRAFTCLGNQAVTYGLGTWHAPMIVLGKEEHLDFSVLIYESLDPDRPEKDCVEEHYSDGDVCIII

SEQ ID NO: 432 - protein, 163 aa, Saccharomyces cerevisiae
  misc_feature (0)...(0): Polypeptide Accession Number YIR037W
MSEFYKLAPVDKKGQPFPFDQLKGKVVLIVNVASKCGFTPQYKELEALYKRYKDEGFTIIGFPCNQFGHQEPGSDEEIAQFCQLNYGVTFPIMKKIDVNGGNEDPVYKFLKSQKSGMLGLRGIKWNFEKFLVDKKGKVYERYSSLTKPSSLSETIEELLKEVE

SEQ ID NO: 433 - protein, 61 aa, Saccharomyces cerevisiae
  misc_feature (0)...(0): Polypeptide Accession Number YIR044C
MKENEVKDEKSVDVLSFKQLESQKTVLPQDVFRNELTWFCYEIYKSLAFRIWMLLWLPLSI

SEQ ID NO: 434 - protein, 215 aa, Saccharomyces cerevisiae
  misc_feature (0)...(0): Polypeptide Accession Number YJL001W
MNGIQVDINRLKKGEVSLGTSIMAVTFKDGVILGADSRTTTGAYIANRVTDKLTRVHDKIWCCRSGSAADTQAIADIVQYHLELYTSQYGTPSTETAASVFKELCYENKDNLTAGIIVAGYDDKNKGEVYTIPLGGSVHKLPYAIAGSGSTFIYGYCDKNFRENMSKEETVDFIKHSLSQAIKWDGSSGGVIRMVVLTAAGVERLIFYPDEYEQL

SEQ ID NO: 435 - protein, 515 aa, Saccharomyces cerevisiae
  misc_feature (0)...(0): Polypeptide Accession Number YJL013C
MKAYAKKRISYMPSSPSQNVINFEEIETQKENILPLKEGRSAAALSKAIHQPLVEINQVKSSFEQRLIDELPALSDPITLYLEYIKWLNNAYPQGGNSKQSGMLTLLERCLSHLKDLERYRNDVRFLKIWFWYIELFTRNSFMESRDIFMYMLRNGIGSELASFYEEFTNLLIQKEKFQYAVKILQLGIKNKARPNKVLEDRLNHLLRELGENNIQLGNEISMDSLESTVLGKTRSEFVNRLELANQNGTSSDVNLTKNNVFVDGEESDVELFETPNRGVYRDGWENFDLKAERNKENNLRISLLEANTNLGELKQHEMLSQKKRPYDEKLPIFRDSIGRSDPVYQMINTKDQKPEKIDCNFKLIYCEDEESKGGRLEFSLEEVLAISRNVYKRVRTNRKHPREANLGQEESANQKEAEAQSKRPKISRKALVSKSLTPSNQGRMFSGEEYINCPMTPKGRSTETSDIISAVKPRQLTPILEMRESNSFSQSKNSEIISDDDKSSSSFISYPPQR

SEQ ID NO: 436 - protein, 514 aa, Saccharomyces cerevisiae
  misc_feature (0)...(0): Polypeptide Accession Number YJL025W
MSTFIRGPICGTDNCPSRLWRIIDGRRTCQYGHVMEGDVEFNDDEDDLNGLGAGVITRRLNLTTNATGSFQSSQLTNSQLLQQQQRQSHKKFKKLIGHEAKLLFLKSFQFILKRQIRWLITEMRFPKEFEHVAKIIWLKILKTINDQPQEELKLQLHMTSTISILYLASTHLSLPVYTCDYIKWICTAKMPYFQASEILPKSWRIQLPNYYVSILEGSISPFNGQLYNKIALTCGMIHFKEFFNSEISCQGLLLKLVMQCALPPEFYFYTKQVIEFEETDIRNLTLWERTDERHTGRVSNHAELRVLSYFMLTINWMLSFDRDRQYPLKWILSLTESLTQRTTTSESIGRNIVKVVYPDKPTSSDYFQWSEEETLEFLKWMEKQFLPTQTKSLHNENGSMEMTIDQKIARRKLYKIFPLDREANHDGEFNDSTHQLTFIEDLQERYAKQTPFFESNKIRDSLNYQEANPPARKEAIGRLLTHIASQLLVDFAISKEQLKDCISRIKNACLHRMN

SEQ ID NO: 437 - protein, 196 aa, Saccharomyces cerevisiae
  misc_feature (0)...(0): Polypeptide Accession Number YJL030W
MSQSISLKGSTRTVTEFFEYSINSILYQRGVYPAEDFVTVKKYDLTLLKTHDDELKDYIRKILLQVHRWLLGGKCNQLVLCIVDKDEGEVVERWSFNVQHISGNSNGQDDVVDLNTTQSQIRALIRQITSSVTFLPELTKEGGYTFTVLAYTDADAKVPLEWADSNSKEIPDGEVVQFKTFSTNDHKVGAQVSYKY

SEQ ID NO: 438 - protein, 423 aa, Saccharomyces cerevisiae
  misc_feature (0)...(0): Polypeptide Accession Number YJL036W
MTDKGKNDLTSKAKDKARGNPEKPPYWFEIIVSDPQKRTGDPGSSSGYVSYQISTKTNNTSFYDNRGDPESIIVVHRRYSDLLLLHDILLNRFPTCIIPPLPDKKVFQYIAGDRFSQRFTQKRCHSLQNFLRRVSLHPDLSQSKVFKTFLVSKDWESHRKVLQDSLQPNKDEVTDAFMNAFKTVHKQNEEFTEIREKSDKLDRTVTKIDKLFHKVVKKNDSMSEDYTKLGSNLQELQELVTGENEELAAKLKIFNEGVTQLSYGLQDLTKYLDYEYIVDLKDLEHYIDSMRQLIKLKDQKQIDYEELSDYLTRSIKEKNNLISGYGGSNFFANKLEELAGINQEASRREKINKLEGKITSLTGELENAKKVADGFEQECLKEIDHFESVKTAEIKKSLGSLADHHIEFYERILEAWEKVDDSL

SEQ ID NO: 439 - protein, 823 aa, Saccharomyces cerevisiae [sequence omitted]

SEQ ID NO: 440 - protein, 396 aa, Saccharomyces cerevisiae
  misc_feature (0)...(0): Polypeptide Accession Number YJL048C
MYEMSGIDSLFHDRVVHDYSHTSEQVIVVYISSAAGDNSWLHQWFKPGNLSDEERENILWVRLVNGTKECLLFKSIFPSSSAPSINILQNGLLECSIQGNSLSREQDPWETFINGLQSVFKGQVTKRKLFSKSNEEYQRVKRMIQNDKLERKYVFQNTNDPQRKPQKWKQLTVTDNVSYKSQKGFLAQNYCTLQLKLPNGYTISNTFPPQTKLHKVRMWLDYNCYDDGTPYLFHRNIPRVTLTRNDELKSLQELDLLPRSTLILEPLEANNKTFDYMEQSSLLHKVYSGLTSFWAKEPEVDASSSRLGYQRLGTNVSNSANYSLQKLSSLDMVSDGGGGGGGDSMTPSAYTTPRMYPSNGTSQLRQNVSELNLSSNNSASNTKVRTLGYSNNNGNN

SEQ ID NO: 441 - protein, 880 aa, Saccharomyces cerevisiae [sequence omitted]

SEQ ID NO: 442 - protein, 667 aa, Saccharomyces cerevisiae
  misc_feature (0)...(0): Polypeptide Accession Number YJL057C
MSLVPYEEGSLILDDPNSKSVVVVNPTSGTLSFFQQDNSNNDSELNEDQTASLSALDFPSGIHQYKSPIASYVCPQCGTEINPDIINRRQLHRRASAGVESESSRLSIPENTVPLGFEFANSSFSRRYFQSLERNHRHYALQNDSNNKQGQFSKNKYFIPDDLFIPGYFRKFFKILSLLGNGARGSVYKVVHTIGNTELGVFALKKIPIGNDMEWFNKCIREVKALSSLTHKSANLITYNHVWLEMDSSVGFVRSIDGSQSDSQEEVPCIFILQQYCSGGNLEDCILRKVFNRFSDTESPEERKKKFRTRKKNHGKSGEVGLSTEQLVSIIRDIARGLHELHSIGLIHRDLKPSNCLLLTPFKSDNENDNVYDREHNSDEFFPSIVIGDLGESQLEGESRLGTGCTGTLEFTAPDLIIQGRPVSSSTLPSRSSHTYNEYTFASDMYSLGMICYFIVFGELPFEPQLDIVDLKVRIKNFRFDTEGMIEKHQAMKLKPIDRRIFHLMDALLQPNNDARPTAKTVEETLDEMLINSKPGKKFWKENVDSTLNFSTISEVNENTNSFTDDYIDGDNVTLSLPAPEENLSTVSTQNLQKYSALNRTIQVCYKLVSMILTIIIFKCTKTGSWLSYMSLILLGMVFKSPADERGKHARALVLLAFIAACKKYIY

SEQ ID NO: 443 - protein, 131 aa, Saccharomyces cerevisiae
  misc_feature (0)...(0): Polypeptide Accession Number YJL064W
MTLVVYLTRFSSTRSLKFFVVGITSFKNCRWPSEECTIAAEMSSYDSVSSSGSGGTCCCCCCCCLCRDSCVSTWTKNSVANAVATNASSEVSIYSGSFLAILCTFSTGNLGEHRGADAVSLPLVSLFIVLA

SEQ ID NO: 444 - protein, 167 aa, Saccharomyces cerevisiae
  misc_feature (0)...(0): Polypeptide Accession Number YJL065C
MNNETSGKETASAPLCSPKLPVEKVQRIAKNDPEYMDTSDDAFVATAFATEFFVQVLTHESLHRQQQQQQQQVPPLPDELTLSYDDISAAIVHSSDGHLQFLNDVIPTTKNLRLLVEENRVRYTTSVMPPNEVYSAYVVNDTAPKPNIVEIDLDNDEDDDEDVTDQE

SEQ ID NO: 445 - protein, 1046 aa, Saccharomyces cerevisiae
  misc_feature (0)...(0): Polypeptide Accession Number YJL084C
MPMDQSISSPLFPMEKDIDIPLDATPLAQSSSLQLFIHLAEPVVFLQGFDPQKTEYPSVVLRGCLVVRILKPTKLKSISLSFKGYSRTEWPEGIPPKRQEFVEIKDIVDHTWALYPPTEQKSKKKMDASAPNESNNAANNFLTKESGASLYRTLSDNETITSRKNSISGLSSLNLSPLGAPGNSSVNVKDRESRQRSRSSSVTSSNGPSRNLSPINLLKRATSPSVSHHNYKPTTTSIFSDLLNNTFTHNDAASHHGHHIPTSSNHLAMTSNNFTSGSGGEFFVFQPGDYIYAFEELIPQAYPESIKADFGFVEYFLFASIERPGAFKSNISARQVVNIVRTQAHNSVEESEPIIISRDWENQLYYDIVIASKDIILDAFLPITFKFAPLDKVTLHRIRIYVTETMEYYCREKKVHRMEPTKKFLLTEQKGPKLPNLPNDANLSKAKNMGNLLQDPKNGDLVNKEYEYQIFIPSRFNNHQQLHPDTSYENIKANHWIKICLRLSRVVDNKRKHYEISIDSPIHVLHRLCSHANTLLPSYDGHPASFPKETDSSISSILESSDDNINLYHNSNIFFPKEVLSSPVLSPNVQPLDILIPHLPSTSLTRNSRQFNRNSKSHPSDNTIFNSAKLKSNIYQPESLQRELASPQAIPLSPITSPMSNMEVPPPDFDFSSDFISDAASGTTTTEVSSSESSILPRDPPSYKDTVLHDNNQKRRPNSKHPTPPSLKASHPNKNSDKNSSETLNKKESMSKIEENKHKRETTPKKRENRDVKSLSTPQREESKDSTSTGNQSNEKNRKRVLSLSSSLHSSPNNSGFAHSALGNLSNESLRSLNRRESVQDNLPSTIRHDNPFFTDLNQVLIEDELKNHDKNELNRHSTNTSSTPASARSSFDYSGINISKDKLNMEPLLSKTETLTNKVNEDSFLRPNDSYVDLLEPSVDTTIDITAPYARNSSAWHPLQNDNDNNQFSPLLGSNENFLNAANAQNSAESDHNNDIFTQGSGLTESSKNSDSEERFISRLSSPEKVLINTLDNESGLQSINESTL

SEQ ID NO: 446 - protein, 440 aa, Saccharomyces cerevisiae
  misc_feature (0)...(0): Polypeptide Accession Number YJL088W
MLSCSVSFRDDKKLVIFSVKCNSQQYRPLRNARTNFFEPDWSPFLSSARLPIPVHPKKSTYINRLFTSKGSLFLVCPLSTVNNEQFFFFFLAIYPSTCTLVTMSTTASTPSSLRHLISIKDLSDEEFRILVQRAQHFKNVFKANKTNDFQSNHLKLLGRTIALIFTKRSTRTRISTEGAATFFGAQPMFLGKEDIQLGVNESFYDTTKVVSSMVSCIFARVNKHEDILAFCKDSSVPIINSLCDKFHPLQAICDLLTIIENFNISLDEVNKGINSKLKMAWIGDANNVINDMCIACLKFGISVSISTPPGIEMDSDIVDEAKKVAERNGATFELTHDSLKASTNANILVTDTFVSMGEEFAKQAKLKQFKGFQINQELVSVADPNYKFMHCLPRHQEEVSDDVFYGEHSIVFEEAENRLYAAMSAIDIFVNNKGNFKDLK

SEQ ID NO: 447 - protein, 1174 aa, Saccharomyces cerevisiae
  misc_feature (0)...(0): Polypeptide Accession Number YJL092W
MSSNNDLWLHLVSQLNTQQRAAALFDYTRGLQVIAGPGTGKTKVLTSRVAYLILHHHIHPRDIIVTTFTNKAANEMKERLQEMLRGAGVNISELLIGTFHSICLKILYRFGHLVDLQKDWRIIDEKEIDVILDDMIEKVPDQIRDYASSITRKVNLCMPSKNGDEWTIHPKLIKKQISKLKSNAILPEEYILDSNHDAALGYFYQIYQSELSKKNTLDFDDLLMYTFRLLTRVRVLSNIKHVLVDEFQDTNGIQLDLMFLFAKGNHHLSRGMTIVGDPDQSIYAFRNALAHNFLEMGRKCPIEYSTIILVENYRSSQKILNTSEILITQQNKGRQNRAPLRAQFDLDFPPVYMNFPAYFLEAPSLVRELLYLKALPNLFTFNDFAILVRQRRQIKRIESALIEHRIPYKIIRGHSFWDSKETRAMLNLLKLIFSPNDKHAILASLLYPARGLGPATGEKIKNALDTLATDVSCFQILKDISSKKIMLDIPTKGRSVIADFISMIENCQLLLQSTLLGGLSDLFDKLYELSGLKYEYLYKDGKKKNDQLEKSEPNLLNARHKNIELLKNYFLALLSKSESSDKEKNEAIKAATDEAEPIENKVITPKEYLRNFFNSLSLHSDAAEEEESESNKDAKIKREKNGFVTISTIHGAKGLEWPVVFIPGCEEGIIPCVFNDDKKDESEEDEEEDQENSKKDASPKKTRVLSVEDSIDEERRMFFVAQTRAKYLLYLSNTVTVEDVDRPRIASRFLTTDLIKAMSDSQKLFESTNSIKKLYRILNKKPPAEDDKLFSLDQLRKDYNQFIENRRERMIWQGIQMNDVYGIQLSRNKLLGSVSDFTSAADQLRLETQNSIFPQKKLIEKSRPSKINGNYAPKSRVKSPEKRYAPETTSFHSPTKKKVYAPQYVSTTNVPSRQEFHSSTGKNIPFLRREDRSITDISPRSSTRSLKGASPNKTSHMSDDLMRPSPTRKDKVTRNIHFATAGTFRIETQSNVDELHPPEYSNKSGQSLTSSEFSGFSSACSNSDQPTNLIEDINNELDLSDEELLNDISIERRRELLGSKKTKKIKPKTRNRKSKRGDKVKVEEVIDLKSEFEEDDSRNTTAAELLHNPDDTTVDNRPIISNAKFLADAAMKKTQKFSKKVKNEPASSQMDIFSQLSRAKKKSKLNNGEIIVID

SEQ ID NO: 448 - protein, 551 aa, Saccharomyces cerevisiae
  misc_feature (0)...(0): Polypeptide Accession Number YJL110C
MASQATTLRGYNIRKRDNVFEPKSSENLNSLNQSEEEGHIGRWPPLGYEAVSAEQKSAVQLRESQAGASISNNMNFKANDKSFSTSTAGRMSPDTNSLHHILPKNQVKNNGQTMDANCNNNVSNDANVPVCKNCLTSTTPLWRRDEHGAMLCNACGLFLKLHGKPRPISLKTDVIKSRNRKSNTNHAHNLDNFRNQTLIAELKGDCNIESSGRKANRVTSEDKKKKSSQLLMGTSSTAKISKKPKTESKERSDSHLSATKLEVLMSGDCSRPNLKPKLPKQDTAIYQEKLLTFPSYTDVKEYSNSAHQSAFIKERSQFNAASFPLNASHSVTSKTGADSPQLPHLSMLLGSLSSTSISNNGSEIVSNCNNGIASTAATLAPTSSRTTDSNPSEVPNQIRSTMSSPDIISAKRNDPAPLSFHMASINDMLETRDRAISNVKTETTPPHFIPFLQSSKAPCISKANSQSISNSVSSSDVSGRKFENHPAKDLGDQLSTKLHKEEEIIKLKTRINELELVTDLYRRHINELDGKCRALEERLQRTVKQEGNKGG

SEQ ID NO: 449 - protein, 714 aa, Saccharomyces cerevisiae
  misc_feature (0)...(0): Polypeptide Accession Number YJL112W
MSVNDQITHIGKTLSTTASAFLNYQKSNSNTQDVLTNNGPYKNLLSNTVNNASSTSYFYKRTEHGRFVKNASNTFEDIYSKTRRGDVFRNKFTDNKTCFRMLTYISDDLLNEIPTKEGLKSDADGKLLTEGGENENLRKNASKKETSLFQGFKSYLPIAELAIENTERLNYDTNGTSGTVGAKDVMSKTNERDEIHTELPNFQDSFLIPPGVETKKISSSYSPSALKSFSQTLVNSLEFLNIQKNSTLSEIRDIEVEVENLRQKKEKLLGKIANIEQNQLLLEDNLKQIDDRLDFLEEYGLEVIEANSDENAEDDGMSERKALKNDAIRNEGVTTESISSEASNLPPRRRQQLRDDNSLNRLGAFYSKSKKRHRKSFPTFQQLYEPGTKIGSIMSTHDDFLTCLDFDAPFGTLCTAGYLDHTVKIWDLSKQNKIGELAGHLATINCMQINRDYGTLVTGGRDAALKLWNLNLAQQLYQETQNLTSPTNHIDSPCVHTFEAHTDEVTALSLDPSFLVSGSQDRTIRQWDLRSGKCLQTIDLSFANVLTTSTNVDLSKSTLLTQRNERPSIGALQSFDAALATGTKDGVVRLWDLRSGKVIRTLKGHTDAITSLKFDSACLVTGSYDRTVRIWDLRTGLLNKFHAYSAPVLSLDLFQENAAVVVADEPSVQIYDSEKDESWSCVEQGNETSVSTVKYKENYMVEGRENGDVNIWAV

SEQ ID NO: 450 - protein, 172 aa, Saccharomyces cerevisiae
  misc_feature (0)...(0): Polypeptide Accession Number YJL124C
MSANSKDRNQSNQDAKRQQQNFPKKISEGEADLYLDQYNFTTTAAIVSSVDRKIFVLLRDGRMLFGVLRTFDQYANLILQDCVERIYFSEENKYAEEDRGIFMIRGENVVMLGEVDIDKEDQPLEAMERIPFKEAWLTKQKNDEKRFKEETHKGKKMARHGIVYDFHKSDMY

SEQ ID NO: 451 - protein, 380 aa, Saccharomyces cerevisiae
  misc_feature (0)...(0): Polypeptide Accession Number YJL137C
MAKKVAICTLLYSRDYLPGALTLAYQLQKLLKHAVVEDEITLCLLIEKKLFGDEFKPQEIALIRSLFKEIIIIEPLKDQEKSIEKNKANLELLKRPELSHTLLKARLWELVQFDQVLFLDADTLPLNKEFFEILRLYPEQTRFQIAAVPDIGWPDMFNTGVLLLIPDLDMATSLQDFLIKTVSIDGADQGIFNQFFNPICNYSKEVLHKVSPLMEWIRLPFTYNVTMPNYGYQSSPAMNFFQQHIRLIHFIGTFKPWSRNTTDYDDHYYQLWRSTQRELYSECHLSNYFTHLQLGNIETETNFYHEPPCLQDLLNHGKRENQKHVDLDITSVDRNASQKSTAEKHDIEKPTSKPQSAFKFDWESTDYLDRVQRAFPKPDT

SEQ ID NO: 452 - protein, 944 aa, Saccharomyces cerevisiae
  misc_feature (0)...(0): Polypeptide Accession Number YJL154C
MAYADSPENAIAVIKQRTALMNRCLSQHKLMESLQHTSIMLTELRNPNLSPKKYYELYVIIFDSLTNLSTYLIENHPQNHHLADLYELVQYTGNVVPRLYLMITVGTSYLTFNEAPKKEILKDMIEMCRGVQNPIRGLFLRYYLSQRTKELLPEDDPSFNSQFIMNNFIEMNKLWVRLQHQGPLRERETRTRERKELQILVGSQLVRLSQIIDDNFQMYKQDILPTILEQVIQCRDLVSQEYLLDVICQVFADEFHLKTLDTLLQTTLHLNPDVSINKIVLTLVDRLNDYVTRQLEDDPNATSTNAYLDMDVFGTFWDYLTVLNHERPDLSLQQFIPLVESVIVLSLKWYPNNFDNLNKLFELVLQKTKDYGQKNISLESEHLFLVLLSFQNSKLQLTSSTTAPPNSPVTSKKHFIFQLISQCQAYKNILALQSISLQKKVVNEIIDILMDREVEEMADNDSESKLHPPGHSAYLVIEDKLQVQRLLSICEPLIISRSGPPANVASSDTNVDEVFFNRHDEEESWILDPIQEKLAHLIHWIMNTTSRKQTMKNKIQFSLEAQLEILLLIKSSFIKGGINVKYTFPAIITNFWKLMRKCRMIQEYLLKKRPDNKTLLSHYSNLLKQMFKFVSRCINDIFNSCNNSCTDLILKLNLQCAILADQLQLNEISYDFFSQAFTIFEESLSDSKTQLQALIYIAQSLQKTRSLYKEAYYDSLIVRCTLHGSKLLKKQDQCRAVYLCSHLWWATEISNIGEEEGITDNFYRDGKRVLECLQRSLRVADSIMDNEQSCELMVEILNRCLYYFIHGDESETHISIKYINGLIELIKTNLKSLKLEDNSASMITNSISDLHITGENNVKASSNADDGSVITDKESNVAIGSDGTYIQLNTLNGSSTLIRGVVATASGSKLLHQLKYIPIHHFRRTCEYIESQREVDDRFKVIYV

SEQ ID NO: 453 - protein, 180 aa, Saccharomyces cerevisiae
  misc_feature (0)...(0): Polypeptide Accession Number YJL160C
MHYKKAFLASLLSSIALTAYAPPEPWATLTPSSKMDGGTTEYRTSFGLAVIPFTVTESKVKRNVISQINDGQVQVTTQKLPHPVSQIGDGQIQVTTQKVPPVVSHIVSQIGDGQLQITTAKNVVTKSTIAVPSKTVTATATSTATAVSQIHDGQVQVTISSASSSSVLSKSKLRANKETK

SEQ ID NO: 454 - protein, 482 aa, Saccharomyces cerevisiae
  misc_feature (0)...(0): Polypeptide Accession Number YJL162C
MSQVIEPQLDRTTYYSILGLTSNATSSEVHKSYLKLARLLHPDKTKSDKSEELFKAVVHAHSILTDEDQKLRYDRDLKIKGLHTYQPKKNCHIFKTKAKESQGASPTLGQSEAYHRQNKPYEQQPYGFGVGKKMTSSSKSKVPIFKSFNLKSYQRNHYYSSKKERKHGSPDIDSLFHETNGASKVRMTDAGKMDTNSQFQEIWEILGKNAYTHKSYSEDPNSCLGSALSDHEEEEEAGKQQQQQQQQQQQQQHYGMTSKSSSPDEEKKNNKEPKRESRVSPEENGEEETGHKQFKLPKTSTFSSGSHDSNLQSPFYNHEYRHYARSKFECKNQFRKSVSPIKEIPATTSANEGWNILRDIIEKLNISNVDDRNKDLLFRRDEIGDKNHSDSIDIENLSIKEPKGMKRRKKDDISLEELFQSLPREKDYFMMDPINDSLESINLFKKPKTTQSHEQGGTFAQAESNRAKFKPLLEQCGITPEI

SEQ ID NO: 455 - protein, 196 aa, Saccharomyces cerevisiae
  misc_feature (0)...(0): Polypeptide Accession Number YJL178C
MLCGLTDVILPGKDAITTQIIDFDKNIGFNVEETESALTLTLKGATWGANSFDAKLEFQCNDNMKQDELTSHTWADKSIQLTLKGPSGCLKSKDDDKKNGDGDNGKDGDSEGKKPAKKAGGTSWFTWLFLYALLFTLIYLMVVSFLNTRGGSFQDFRAEFIQRSTQFLTSLPEFCKEVVSRILGRSTAQRGGYSAV

SEQ ID NO: 456 - protein, 123 aa, Saccharomyces cerevisiae
  misc_feature (0)...(0): Polypeptide Accession Number YJL184W
MKLPVAQYSAPDGVEKSFAPIRDDPRYMTTEGRTTGPSDHVLNAGQIDRDKPSEPERTKDGSQLTYLGQLRTQLTGLQDDINEFLTGRMELAKNKKKAGADEKRIQEEINQLLDGGDGDEDAV

SEQ ID NO: 457 - protein, 293 aa, Saccharomyces cerevisiae
  misc_feature (0)...(0): Polypeptide Accession Number YJL185C
MASVNNYQVDCGSRSARIQPRINNGIHDEESLFEVLELSEEEFELDFHRLKSFNDVRVINNPDLSPECTNTAISRDETLESASSAFEVPSDEIAILSISSDSNKNSPPSEQPAPALRNIRSSSNSDRIDEWCLGSHLFNELHQNVPQSSDGVNHGFPVYSFKERELYTSAKLKKLTNAQRIAVQKLSRDLYPILRTCYREKTRRQLLTYHHERIFDDIPSFFPQRDFIFNYYSMPLEFDRLSDVDIDSSSRSRFTDESTGETLNRSPSAASSSLENTSWFGWTLLSRFLDREW

SEQ ID NO: 458 - protein, 147 aa, Saccharomyces cerevisiae
  misc_feature (0)...(0): Polypeptide Accession Number YJL211C
MCDLLPHVPCQDSDDIQGAFPALKNHATECGSIRTARAIVWQEPRRAHKHNCVQCQLPFLFVFTRIECCIELGPKLSIQFFIKRYRVELCNSRHAALPLDYVFSVISAISPRYAFPPSSLIPYNAFPSNLIDRMEGKSHPFHSSDRY

SEQ ID NO: 459 - protein, 196 aa, Saccharomyces cerevisiae
  misc_feature (0)...(0): Polypeptide Accession Number YJL218W
MGVLENIVPGELYDANYDPDLLKIRKETKIKLHEYNTLSPADENKKSQVIRELLGSCTDNFIIEPPFYCDYGSNIYIGDNFYANHNLVILDGAKVVIGDNVFIAPNVGIYTAGHPIDVERRLQGLEYAMPVTIGDNVWIGGGVSIIPGVNIGKNSVIAAGSVVIRDIPENVVAAGNPCKVIRKITEKDSTTTNYRK

SEQ ID NO: 460 - protein, 332 aa, Saccharomyces cerevisiae
  misc_feature (0)...(0): Polypeptide Accession Number YJR009C
MVRVAINGFGRIGRLVMRIALQRKNVEVVALNDPFISNDYSAYMFKYDSTHGRYAGEVSHDDKHIIVDGHKIATFQERDPANLPWASLNIDIAIDSTGVFKELDTAQKHIDAGAKKVVITAPSSTAPMFVMGVNEEKYTSDLKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSNSSIFDAAAGIQLSPKFVKLVSWYDNEYGYSTRVVDLVEHVAKA

SEQ ID NO: 461 - protein, 244 aa, Saccharomyces cerevisiae
  misc_feature (0)...(0): Polypeptide Accession Number YJR024C
MSSQDVLIHSDDPCHPANLICTLCKQFFHNNWCTGTGGGISIKDPNTNYYYLAPSGVQKEKMIPEDLFVMDAQTLEYLRSPKLYKPSACTPLFLACYQKKNAGAIIHTHSQNAVICSLLFGDEFRIANIEQIKAIPSGKVDPVTKKPMALSFFDTLKIPIIENMAHEDELIDDLHKTFKDYPDTCAVIVRRHGIFVWGPTIDKAKIFNEAIDYLMELAIKMYQMGIPPDCGIGEEKKHLKMASP

SEQ ID NO: 462 - protein, 108 aa, Saccharomyces cerevisiae
  misc_feature (0)...(0): Polypeptide Accession Number YJR034W
MVASCKDQKKAVAICLQRSPCVMIERHNPQECLDNPELNKDLPELCIAQMKAFLDCKRGIVDMTKRFTGNAPLSTGKYDQQYENLCKGKFDPREEMEKLKLLNSQQKD

SEQ ID NO: 463 - protein, 530 aa, Saccharomyces cerevisiae
  misc_feature (0)...(0): Polypeptide Accession Number YJR049C
MKENDMNNGVDKWVNEEDGRNDHHNNNNNLMKKAMMNNEQIDRTQDIDNAKEMLRKISSESSSRRSSLLNKDSSLVNGNANSGGGTSINGTRGSSKSSNTHFQYASTAYGVRMLSKDISNTKVELDVENLMIVTKLNDVSLYFLTRELVEWVLVHFPRVTVYVDSELKNSKKFAAGELCEDSKCRESRIKYWTKDFIREHDVFFDLVVTLGGDGTVLFVSSIFQRHVPPVMSFSLGSLGFLTNFKFEHFREDLPRIMNHKIKTNLRLRLECTIYRRHRPEVDPNTGKKICVVEKLSTHHILNEVTIDRGPSPFLSMLELYGDGSLMTVAQADGLIAATPTGSTAYSLSAGGSLVCPTVNAIALTPICPHALSFRPIILPESINLKVKVSMKSRAPAWAAFDGKDRIELQKGDFITICASPYAFPTVEASPDEFINSISRQLNWNVREQQKSFTHILSQKNQEKYAHEANKVRNQAEPLEVIRDKYSLEADATKENNNGSDDESDDESVNCEACKLKPSSVPKPSQARFSV

SEQ ID NO: 464 - protein, 235 aa, Saccharomyces cerevisiae
  misc_feature (0)...(0): Polypeptide Accession Number YJR050W
MSRNVDKANSVLVRFQEQQAESAGGYKDYSRYQRPRNVSKVKSIKEANEWKRQVSKEIKQKSTRIYDPSLNEMQIAELNDELNNLFKEWKRWQWHIDHTLMEKKTKRKRLEDSHVLMNSGKLINGKRYFGRALELPEVKEWLKQSQRQNDGGSINTKCIPKDRNDFYYHGKVTAALTEFEANWTSILKAHYNVPVNEDEEEMSRQTQEIHVPTLADMEHWLVQRRKKKLMDELNL

SEQ ID NO: 465 - protein, 385 aa, Saccharomyces cerevisiae
  misc_feature (0)...(0): Polypeptide Accession Number YJR072C
MSLSTIICIGMAGSGKTTFMQRLNSHLRAEKTPPYVINLDPAVLRVPYGANIDIRDSIKYKKVMENYQLGPNGAIVTSLNLFSTKIDQVIRLVEQKKDKFQNCIIDTPGQIECFVWSASGAIITESFASSFPTVIAYIVDTPRNSSPTTFMSNMLYACSILYKTKLPMIVVFNKTDVCKADFAKEWMTDFESFQAAIKEDQDLNGDNGLGSGYMSSLVNSMSLMLEEFYSQLDVVGVSSFTGDGFDEFMQCVDKKVDEYDQYYKQEREKALNLKKKKEEMRKQKSLNGLMKDLGLNEKSSAAASDNDSIDAISDLEEDANDGLVDRDEDEGVEREYTFPGEERTKGEVNENSAPDLQRRYQEAMQQVGKTASSETAENIAKYIRN

SEQ ID NO: 466 - protein, 218 aa, Saccharomyces cerevisiae
  misc_feature (0)...(0): Polypeptide Accession Number YJR074W
MKIEKASHISQPVQLSTCTLIDTYPGHQGSMNNKEVELYGGAITTVVPPGFIDASTLREVPDTQEVYVNSRRDEEEFEDGLATNESIIVDLLETVDKSDLKEAWQFHVEDLTELNGTTKWEALQEDTVQQGTKFTGLVMEVANKWGKPDLAQTVVIGVALIRLTQFDTDVVISINVPLTKEEASQASNKELPARCHAVYQLLQEMVRKFHVVDTSLFA

SEQ ID NO: 467 - protein, 415 aa, Saccharomyces cerevisiae
  misc_feature (0)...(0): Polypeptide Accession Number YJR076C
MSGIIDASSALRKRKHLKRGITFTVMIVGQSGSGRSTFINTLCGQQVVDTSTTILLPTDTSTEIDLQLREETVELEDDEGVKIQLNIIDTPGFGDSLDNSPSFEIISDYIRHQYDEILLEESRVRRNPRFKDGRVHCCLYLINPTGHGLKEIDVEFIRQLGSLVNIIPVISKSDSLTRDELKLNKKLIMEDIDRWNLPIYNFPFDEDEISDEDYETNMYLRTLLPFAIIGSNEVYEMGGDVGTIRGRKYPWGILDVEDSSISDFVILRNALLISHLHDLKNYTHEILYERYRTEALSGESVAAESIRPNLTKLNGSSSSSTTTRRNTNPFKQSNNINNDVLNPASDMHGQSTGENNETYMTREEQIRLEEERLKAFEERVQQELLLKRQELLQREKELREIEARLEKEAKIKQEE

SEQ ID NO: 468 - protein, 110 aa, Saccharomyces cerevisiae
  misc_feature (0)...(0): Polypeptide Accession Number YJR086W
MTSVQNSPRLQQPQEQQQQQQQLSLKIKQLKLKRINELNNKLRKELSRERITASNACLTIINYTSNTKDYTLPELWGYPVAGSNHFIEGLKNAQKNSQMSNSNSVCCTLM

SEQ ID NO: 469 - protein, 1091 aa, Saccharomyces cerevisiae
  misc_feature (0)...(0): Polypeptide Accession Number YJR091C
MDKSKQMNINNLSNIPEVIDPGITIPIYEEEYENNGESNSQLQQQPQKLGSYRSRAGKFSNTLSNLLPSISAKLHHSKKNSHGKNGAEFSSSNNSSQSTVASKTPRASPSRSKMMESSIDGVTMDRPGSLTPPQDMEKLVHFPDSSNNFLIPAPRGSSDSFNLPHQISRTRNNTMSSQITSISSIAPKPRTSSGIWSSNASANDPMQQHLLQQLQPTTSNNTTNSNTLNDYSTKTAYFDNMVSTSGSQMADNKMNTNNLAIPNSVWSNTRQRSQSNASSIYTDAPLYEQPARASISSHYTIPTQESPLIADEIDPQSINWVTMDPTVPSINQISNLLPTNTISISNVFPLQHQQPQLNNAINLTSTSLATLCSKYGEVISARTLRNLNMALVEFSSVESAVKALDSLQGKEVSMIGAPSKISFAKILPMHQQPPQFLLNSQGLPLGLENNNLQPQPLLQEQLFNGAVTFQQQGNVSIPVFNQQSQQSQHQNHSSGSAGFSNVLHGYNNNNSMHGNNNNSANEKEQCPFPLPPPNVNEKEDLLREIIELFEANSDEYQINSLIKKSLNHKGTSDTQNFGPLPEPLSGREFDPPKLRELRKSIDSNAFSDLEIEQLAIAMLDELPELSSDYLGNTIVQKLFEHSSDIIKDIMLRKTSKYLTSMGVHKNGTWACQKMITMAHTPRQIMQVTQGVKDYCTPLINDQFGNYVIQCVLKFGFPWNQFIFESIIANFWVIVQNRYGARAVRACLEAHDIVTPEQSIVLSAMIVTYAEYLSTNSNGALLVTWFLDTSVLPNRHSILAPRLTKRIVELCGHRLASLTILKVLNYRGDDNARKIILDSLFGNVNAHDSSPPKELTKLLCETNYGPTFVHKVLAMPLLEDDLRAHIIKQVRKVLTDSTQIQPSRRLLEEVGLASPSSTHNKTKQQQQQHHNSSISHMFATPDTSGQHMRGLSVSSVKSGGSKHTTMNTTTTNGSSASTLSPGQPLNANSNSSMGYFSYPGVFPVSGFSGNASNGYAMNNDDLSSQFDMLNFNNGTRLSLPQLSLTNHNNTTMELVNNVGSSQPHTNNNNNNNNTNYNDDNTVFETLTLHSAN

SEQ ID NO: 470 - protein, 327 aa, Saccharomyces cerevisiae
  misc_feature (0)...(0): Polypeptide Accession Number YJR093C
MSSSEDEDDKFLYGSDSELALPSSKRSRDDEADAGASSNPDIVKRQKFDSPVEETPATARDDRSDEDIYSDSSDDDSDSDLEVIISLGPDPTRLDAKLLDSYSTAATSSSKDVISVATDVSNTITKTSDERLITEGEANQGVTATTVKATESDGNVPKAMTGSIDLDKEGIFDSVGITTIDPEVLKEKPWRQPGANLSDYFNYGFNEFTWMEYLHRQEKLQQDYNPRRILMGLLSLQQQGKLNSANDTDSNLGNIIDNNNNVNNANMSNLNSNMGNSMSGTPNPPAPPMHPSFPPLPMFGSFPPFPMPGMMPPMNQQPNQNQNQNSK

SEQ ID NO: 471 - protein, 360 aa, Saccharomyces cerevisiae
  misc_feature (0)...(0): Polypeptide Accession Number YJR094C
MQADMHGKLHAALEDGFFLFPFEQQQQPNIYYDTTTDQEDRPCFSFGSTISPRSWHFEKSDKIASSQLQNLVHTQPIHLINPQILFNEEFLNLENIDSQPISKETKTTKDCTMATGPERGKKSSESTRSSSLSSLFSNDESASTFHSSFNNHDNFQKSNRNGDDIDISDTIKYETNTNAQKDIKIFQENFEFNEFPYTQDFYPYTTNYTYSKPTNIHESINSKNTDSYSQYQDQFPPHTDNIHSFNNRHYSNHKSTNCNYYNNTSNNNNASDNVYEADPFIDEPQVPSYYYPLEIAFDVEKSPPPSLQKLNSKELEFLKKLNSKLSRYAAAYSFSSSNDQDYYDKVRFQEISYKFSKTYS

SEQ ID NO: 472 - protein, 453 aa, Saccharomyces cerevisiae
  misc_feature (0)...(0): Polypeptide Accession Number YJR117W
MFDLKTILDHPNIPWKLIISGFSIAQFSFESYLTYRQYQKLSETKLPPVLEDEIDDETFHKSRNYSRAKAKFSIFGDVYNLAQKLVFIKYDLFPKIWHMAVSLLNAVLPVRFHMVSTVAQSLCFLGLLSSLSTLVDLPLSYYSHFVLEEKFGFNKLTVQLWITDMIKSLTLAYAIGGPILYLFLKIFDKFPTDFLWYIMVFLFVVQILAMTIIPVFIMPMFNKFTPLEDGELKKSIESLADRVGFPLDKIFVIDGSKRSSHSNAYFTGLPFTSKRIVLFDTLVNSNSTDEITAVLAHEIGHWQKNHIVNMVIFSQLHTFLIFSLFTSIYRNTSFYNTFGFFLEKSTGSFVDPVITKEFPIIIGFMLFNDLLTPLECAMQFVMSLISRTHEYQADAYAKKLGYKQNLCRALIDLQIKNLSTMNVDPLYSSYHYSHPTLAERLTALDYVSEKKKN

SEQ ID NO: 473 - protein, 497 aa, Saccharomyces cerevisiae
  misc_feature (0)...(0): Polypeptide Accession Number YJR122W
MFISRRCRIKGFTLKNLLWFRSSSTRFVSTESPDASAITKPDGIFNYSLLENRTYIRIRGPDTVKFLNGLVTSKLLPHFIKKNLTTVEENEVPTEEGTTKVDPIIPVPEFDARLGNWGLYNEKGIQGPYISRFGLYSAFLNGKGKLITDTIIYPTPVTVSEQISNYPEYLLELHGNVVDKILHVLQTHKLANKIKFEKIDHSSLKTWDVEVQFPNLPKDIENPWFDNLLDPMALPKNSIDANNFAVNVLNSLFNSDPRILGIYVERRTESMSRHYSTFPQSFRVVTSEQVDDLSKLFNFNVFDFPFQVNKKASVQVREIRFQKGLIDSTEDYISETLLPLELNFDFFPNTISTNKGCYVGQELTARTYATGILRKRLVPVKLDNYQLLDTDPERKYAEFHIDNVVEKSLAENEPTLNPFTNKPPERTKRKQRPAGLLISNEGLYGVALLRTEHFSAAFSSDEPVEFYITTTKGENIKITPQKPFWFSDWKNNNGPHK

SEQ ID NO: 474 - protein, 408 aa, Saccharomyces cerevisiae
  misc_feature (0)...(0): Polypeptide Accession Number YJR125C
MSLEDTLANMSLYDAKKYFRKAQNVVFNYTEMEGKVREATNNEPWGASSTLMDQISQGTYNFREREEILSMIFRRFTEKAGSEWRQIYKALQLLDYLIKHGSERFIDDTRNSINLIRILETFHYIDSQGRDQGINVRTRVKALIELLSDDNKIRAERKKARETAKKYKGVAGGSASADGSLNSKAGFTSTKVHGISVSADFDSDNEDNEDGSFSQNGYNDNASRATSTPGQGKQEPEDFVDFFSSESSKPSKELIQEDEKKADEEEDDDDEFSEFQSAVPVTNPANSFNLLNTSPIEGMPATTSSMPFYNSSTTDQGKITPAIAEPKKVDPFSSLFSTAKASAEAPSAPKASQAKAAASNPVSNSTTALSTDQDDDDEFGEMHGGAVQQEQNTNNNHTSSKEIDLLSF

SEQ ID NO: 475 - protein, 209 aa, Saccharomyces cerevisiae
  misc_feature (0)...(0): Polypeptide Accession Number YJR133W
MAENERMYISYNNIHKLCQGVAKHILARNERPDIIIAITGGGMIPARIIRSFLKTKGQKNIPIQAIGLSLYEDLGLDNSVETIGKEVIRTQWLDFGALNQHFDSLIGKKVLIVDEVDDTRTTLHYAVSELEKEIAEQQKVLNRMSEETVISIFVLHNKDKPKRAGLPDSMMNSGRYIAAQTVPDKWLCYPWDAEDIEEHTMLAKAQGHD

SEQ ID NO: 476 - protein, 239 aa, Saccharomyces cerevisiae
  misc_feature (0)...(0): Polypeptide Accession Number YJR135C
MDVEKDVLDVYIKNLENQIGNKRYFLKQAQGAIDEITKRSLDTEGKPVNSEVFTELLRKPMFFSERADPIGFSLTSNFLSLRAQSSSEWLSLMNDQSVDQKAMLLLQNNINSDLKELLRKLQHQMTIMDSKKQDHAHIRTRKARNKELWDSLADFLKGYLVPNLDDNDESIDSLTNEVMLLMKRLIEHDLNLTLNDFSSKTIPIYRLLLRANIITVIEGSTNPGTKYIKLIDFNETSLT

SEQ ID NO: 477 - protein, 421 aa, Saccharomyces cerevisiae
  misc_feature (0)...(0): Polypeptide Accession Number YJR136C
MTAVTDIIDELNDSSLSSTRLRELCLQLRKKTDTGCAITVSDEVNLIESLSYHSISPGVDIQINTDVLQTIDYYFQRNKSEHDEIMCVLISKLQPLLLKRKSNFELKEQRNLGLKPTLGMSLKEDNLMQAWVSQGGLKGIPLFYVILLHLKRRDISTNLSWIIPGILNILDDTTDIRRIKLRGVLLLQTLLNHTFMNETNDSKWIQFSSTGLFPLFEKTLINMCYFLPPSYNADETIAIWRVVFPTIQSLYKVEFLDNYTKYQYHLEKFMSEIILQNIIPRASLAYENLTLYALECTMNILRLQREGSVVHLQRLIFVLGEYIVRNPFYTTFPKLISKTLSVVSTLIKVCPNERIVAHRFDILSLILVTYDKCSQEDALNESILQQCKETISWLLNCDCAMGEQLSTLSKQPRFQLLFEFS

SEQ ID NO: 478 - protein, 357 aa, Saccharomyces cerevisiae
  misc_feature (0)...(0): Polypeptide Accession Number YJR159W
MSQNSNPAVVLEKVGDIAIEQRPIPTIKDPHYVKLAIKATGICGSDIHYYRSGGIGKYILKAPMVLGHESSGQVVEVGDAVTRVKVGDRVAIEPGVPSRYSDETKEGRYNLCPHMAFAATPPIDGTLVKYYLSPEDFLVKLPEGVSYEEGACVEPLSVGVHSNKLAGVRFGTKVVVFGAGPVGLLTGAVARAFGATDVIFVDVFDNKLQRAKDFGATNTFNSSQFSTDKAQDLADGVQKLLGGNHADVVFECSGADVCIDAAVKTTKVGGTMVQVGMGKNYTNFPIAEVSGKEMKLIGCFRYSFGDYRDAVNLVATGKVNVKPLITHKFKFEDAAKAYDYNIAHGGEVVKTIIFGPE

SEQ ID NO: 479 - protein, 202 aa, Saccharomyces cerevisiae
  misc_feature (0)...(0): Polypeptide Accession Number YKL001C
MATNITWHPNLTYDERKALRKQDGCTIWLTGLSASGKSTIACALEQLLLQKNLSAYRLDGDNIRFGLNKDLGFSEKDRNENIRRISEVSKLFADSCAISITSFISPYRVDRDRARELHKEAGLKFIEIFVDVPLEVAEQRDPKGLYKKAREGVIKEFTGISAPYEAPKAPELHLRTDQKTVEECATIIYEYLISEKIIRKHL

SEQ ID NO: 480 - protein, 151 aa, Saccharomyces cerevisiae
  misc_feature (0)...(0): Polypeptide Accession Number YKL002W
MKAQLQAISLRIQAVRSSDQMTRSMSEATGLLAGMNRTMNLPQLQRISMEFEKQSDLMGQRQEFMDEAIDNVMGDEVDEDEEADEIVNKVLDEIGVDLNSQLQSTPQNLVSNAPIAETAMGIPEPIGAGSEFHGNPDDDLQARLNTLKKQT

SEQ ID NO: 481 - protein, 583 aa, Saccharomyces cerevisiae
  misc_feature (0)...(0): Polypeptide Accession Number YKL012W
MSIWKEAKDASGRIYYYNTLTKKSTWEKPKELISQEELLLRENGWKAAKTADGKVYYYNPTTRETSWTIPAFEKKVEPIAEQKHDTVSHAQVNGNRIALTAGEKQEPGRTINEEESQYANNSKLLNVRRRTKEEAEKEFITMLKENQVDSTWSFSRIISELGTRDPRYWMVDDDPLWKKEMFEKYLSNRSADQLLKEHNETSKFKEAFQKMLQNNSHIKYYTRWPTAKRLIADEPIYKHSVVNEKTKRQTFQDYIDTLIDTQKESKKKLKTQALKELREYLNGIITTSSSETFITWQQLLNHYVFDKSKRYMANRHFKVLTHEDVLNEYLKIVNTIENDLQNKLNELRLRNYTRDRIARDNFKSLLREVPIKIKANTRWSDIYPHIKSDPRFLHMLGRNGSSCLDLFLDFVDEQRMYIFAQRSIAQQTLIDQNFEWNDADSDEITKQNIEKVLENDRKFDKVDKEDISLIVDGLIKQRNEKIQQKLQNERRILEQKKHYFWLLLQRTYTKTGKPKPSTWDLASKELGESLEYKALGDEDNIRRQIFEDFKPESSAPTAESATANLTLTASKKRHLTPAVELDY

SEQ ID NO: 482 - protein, 979 aa, Saccharomyces cerevisiae
  misc_feature (0)...(0): Polypeptide Accession Number YKL015W
MVTDQGSRHSIQSKQPAYVNKQPQKRQQRSSVACLSCRKRHIKCPGGNPCQKCVTSNAICEYLEPSKKIVVSTKYLQQLQKDLNDKTEENNRLKALLLERPVSVRGKDNSDDDERHINNAPSSDTLEVSSAPAAPIFDLMSNSNTASDNDNDDDNSNRITNNRSYDHSLEKYYKKAISIFKQPANANGENGNGANGHEDDDEDDEEISTNFAQRSGRLIESHNGFHYFVGSSSMTLFGLEIQSLVTKYISVKNFRPLPINTKNKILNSNLNPAISSFINSNNYLFSSYNFLNPISTIVNLNSINDNLSPLMFKIILKSDTDGSSGQEEVIQFQLPSYNYTKLLIDCFINYNDGCFYFFNEGLVKCGINKLYLENKWLYYDNTKKALDNENDPILQAVWFCKILLILAVGEMYLGSINNEMLKNYSNQPKLPGSKFFQMGSKIFNCLFSSERLENVTKKGGIEVLLLYAFFLQVADYTLASYFYFGQALRTCLILGLHVDSQSDTLSRYEIEHHRRLWWTVYMFERMLSSKAGLPLSFTDYTISTALPADIDDETIEEKNSHYVFRKAELISNCVTIVKINAQILSKLYQRQPETNIIITLKVVIKQLLEWRNNLSDSLQVDFTQKDEDFKISRLSTNMFTEYFQGINLAVRPLLFHFASIQLKRFKTSNTFVNLQNYSATISSLLTCSLHASVNTIRSLWSLLQNSMLAMFSYMDREYLFTSSCTLLLFNTAFGIHEQTLYHLDHSLEIFTQMRNLGNIPAGLRRAQLLTLMANLDFHGIMNDLITKYNDILKFDSMNCENDNIVEDSNEPKRETEKCKPHKDGDRIDPSIIDCDKSNTNTNMIKNESISNIVSILPEGAKPTLTDYSNGNNDVNDINVNNSEPSTFFDIITASLENSYQTTLTEKGSQVMEKNMDQLDSVHNLNDDDLQQLLEDLGNIDHSDEKLWKEITDQAMWLGNTMDPTAAAGSEIDFTDYLGP

SEQ ID NO: 483 - protein, 683 aa, Saccharomyces cerevisiae
  misc_feature (0)...(0): Polypeptide Accession Number YKL017C
MNKELASKFLSSIKHEREQDIQTTSRLLTTLSIQQLVQNGLAINNIHLENIRSGLIGKLYMELGPNLAVNDKIQRGDIKVGDIVLVRPAKTKVNTKTKPKVKKVSEDSNGEQAECSGVVYKMSDTQITIALEESQDVIATTFYSYSKLYILKTTNVVTYNRMESTMRKLSEISSPIQDKIIQYLVNERPFIPNTNSFQNIKSFLNPNLNDSQKTAINFAINNDLTIIHGPPGTGKTFTLIELIQQLLIKNPEERILICGPSNISVDTILERLTPLVPNNLLLRIGHPARLLDSNKRHSLDILSKKNTIVKDISQEIDKLIQENKKLKNYKQRKENWNEIKLLRKDLKKREFKTIKDLIIQSRIVVTTLHGSSSRELCSLYRDDPNFQLFDTLIIDEVSQAMEPQCWIPLIAHQNQFHKLVLAGDNKQLPPTIKTEDDKNVIHNLETTLFDRIIKIFPKRDMVKFLNVQYRMNQKIMEFPSHSMYNGKLLADATVANRLLIDLPTVDATPSEDDDDTKIPLIWYDTQGDEFQETADEATILGSKYNEGEIAIVKEHIENLRSFNVPENSIGVISPYNAQVSHLKKLIHDELKLTDIEISTVDGFQGREKDVIILSLVRSNEKFEVGFLKEERRLNVAMTRPRRQLVVVGNIEVLQRCGNKYLKSWSEWCEENADVRYPNIDDYL

SEQ ID NO: 484 - protein, 316 aa, Saccharomyces cerevisiae
  misc_feature (0)...(0): Polypeptide Accession Number YKL019W
MEEYDYSDVKPLPIETDLQDELCRIMYTEDYKRLMGLARALISLNELSPRALQLTAEIIDVAPAFYTIWNYRFNIVRHMMSESEDTVLYLNKELDWLDEVTLNNPKNYQIWSYRQSLLKLHPSPSFKRELPILKLMIDDDSKNYHVWSYRKWCCLFFSDFQHELAYASDLIETDIYNNSAWTHRMFYWVNAKDVISKVELADELQFIMDKIQLVPQNISPWTYLRGFQELFHDRLQWDSKVVDFATTFIGDVLSLPIGSPEDLPEIESSYALEFLAYHWGADPCTRDNAVKAYSLLAIKYDPIRKNLWHHKINNLN

SEQ ID NO: 485 - protein, 277 aa, Saccharomyces cerevisiae
  misc_feature (0)...(0): Polypeptide Accession Number YKL023W
MNKEELLGFLLDDSIDSQKRCVTDHEAYSNWLKNDNDERTAHEESSSQSTIAALNKKKQTEAAQEDIEELLNGLEGIIGGADPRNLKSKSKRKTKKGGSKPREENVNTEKHIVMLEVEDFSDMSTHEDVNGASPSPNLDRSKKNEKRRKNAKELSYDELKDKLEVTTRKSRLECKDLKKKVHGLERRNLELEQRLEELKIENQTLIEINNKLLKNTNEDEINKSQRNKEKDRKRRERRTARRKDERKQEKKQEKKQDNKTSQSFPSSTDMNGQPIEF

SEQ ID NO: 486 - protein, 482 aa, Saccharomyces cerevisiae
  misc_feature (0)...(0): Polypeptide Accession Number YKL028W
MDRPIDDIVKNLLKFVVRGFYGGSFVLVLDAILFHSVLAEDDLKQLLSINKTELGPLIARLRSDRLISIHKQREYPPNSKSVERVYYYVKYPHAIDAIKWKVHQVVQRLKDDLDKNSEPNGYMCPICLTKYTQLEAVQLLNFDRTEFLCSLCDEPLVEDDSGKKNKEKQDKLNRLMDQIQPIIDSLKKIDDSRIEENTFEIALARLIPPQNQSHAAYTYNPKKGSTMFRPGDSAPLPNLMGTALGNDSSRRAGANSQATLHINITTASDEVAQRELQERQAEEKRKQNAVPEWHKQSTIGKTALGRLDNEEEFDPVVTASAMDSINPDNEPAQETSYQNNRTLTEQEMEERENEKTLNDYYAALAKKQAKLNKEEEEEEEEEEDEEEEEEEEMEDVMDDNDETARENALEDEFEDVTDTAGTAKTESNTSNDVKQESINDKTEDAVNATATASGPSANAKPNDGDDDDDDDDDEMDIEFEDV

SEQ ID NO: 487 - protein, 1038 aa, Saccharomyces cerevisiae
  misc_feature (0)...(0): Polypeptide Accession Number YKL033W
MNSDTNAFKDIRISCVELSRIAFLPTESFDPNSLTLLACLKKVEEKLSAYEDDSLSPKFADYVFVPIASLLKQPALGESQTEYVLLIIFHLLRTCWSSNGKFSEQLGQQLFPLITFLVSSDKDNQKLITRSDEFKYAGCLVLHQFFKSVRSQRYHKEFFSNSKPNLLPALGHSVTILLKILEQSPQNNELQFKALASLEVLFQDIISDGEMLSFILPGNVSVFAKILTKPGRQIHYKVCVRTLEVLAKLLVLVYDDFSLDIKVNKLTDIRELSDTKLKHEINQSFMFNGPIVLLRTDGKTHRDTSWLTATSGQINIALEAFIPKLLKRNNESIDEALATFVSILLTRCENSLNNCEKVLVSTLVHLERDPMSKLPSHLVKLKEVVNEDLHKLSDIIRFENADRLSSLSFAITILEKNNERDTMINEVVRCLFESLNESIEPPSLINHKERIIEQSSQLTTTVNFENLESTNALIALPRLSEDMSLKLKKFTYHMGSLLLERHILNDVVTELISEQVDSPRTQKIVALWLSTNFIKAMEKQPKEEEVYLQFESDANYSSSMVEEVCLIVLEFCNELSQDISMEIEGKGIKKSDEFAVCTVLFSIETICAVMREEFQPELIDYIYTVVDALASPSEAIRYVSQSCALRIADTLYHGSIPNMILSNVDYLVESISSRLNSGMTERVSQILMVICQLAGYETIENFKDVIETIFKLLDYYHGYSDLCLQFFQLFKIIILEMKKKYINDDEMILKIANQHISQSTFSPWGMTDFQQVLNILDKETQVKDDITDENDVDFLKDDNEPSNFQEYFDSKLREPDSDDDEEEREEEVEGSSKEYTDQWTSPIPSDSYKILLQILGYGERLLTHPSKRLRVQILIVMRLIFPLLSTQHNLLIREVASTWDSIIQCVLCSDYSIVQPACSCVEQMIKYSGDFVAKRFIELWQKLCQDSFILKELRIDPTVHNHEKKSISKHVKFPPVTENALVSMVHMVLEGVKITEYLISEAVLEQIIYCCIQVVPVEKISSMSLIVGDIVWKIRNIN

SEQ ID NO: 488 - protein, 531 aa, Saccharomyces cerevisiae
  misc_feature (0)...(0): Polypeptide Accession Number YKL039W
MRVYQFCRPFQLFTCFLCYLLVFVKANKEKISQKNYQVCAGMYSKEDWKGKIDPFISFNLKKISGLSDESDPGLVVAIYDFQDFEHLGVQLPDEEMYYICDDYAIDIGICEEENRDEFIVQDVVYDPYTSTNRSLANPIMTFSQNEVGLHDTRYPIKETGFYCVTAFRSSTSTKFNAVVNFRNAYGQLAGTEINKLPLYGLLAVAYVVAMALYSFAFWKHKHELLPLQKYLLAFFVFLTAETIFVWAYYDLKNEKGDTAGIKVYMVFLSILTAGKVTFSFFLLLIIALGYGIVYPKLNKTLMRRCQMYGALTYAICIGFLIQSYLTDMEAPSPLILITLIPMALALIIFYYMIIRSMTKTVIYLKEQRQIVKLNMYKKLLYIIYASFLSVLAGSIVSSFIYVGMNTIDMIEKNWRSRFFVTDFWPTLVYFIVFVTIAFLWRPTDTSYMLAASQQLPTDPENVADFDLGDLQSFDDQDDASIITGERGIDEDDLNLNFTDDEEGHDNVNNHSQATGQCLPLQQNNATSSRFD

SEQ ID NO: 489 - protein, 292 aa, Saccharomyces cerevisiae
  misc_feature (0)...(0): Polypeptide Accession Number YKL052C
MDSASKEETLEKLVQEITVNLQKIDSNLSFCFHKITQDIIPHVATYSEICERIMDSTEWLGTMFQETGLVNLQANAAAPVGNAPVKSLVSNNVGIFPTSAEEASRQSQTDNGPNEADSAVHVNRDVHSMFNNDSIDDFHTANITSTGQILKLPDSSDEDTGSEAVPSREQTDLTGEGHGGADDEQDESTIQRQSRKRKISLLLQQQYGSSSSMVPSPIVPNKMRKQLAHEEHINNDGDNDDENSNNIESSPLKQGHHHPKGQADDNNEGPDEEESTKEVPKPGTIIHFSTNR

SEQ ID NO: 490 - protein, 113 aa, Saccharomyces cerevisiae
  misc_feature (0)...(0): Polypeptide Accession Number YKL061W
MGEQNKLYYDVEKLVNSLQESFDLDCAQSVSLFTSKSRSNEAWLEELENKFKLKDDVELDDVENLRAEIDMKLNMLEDKVSYYERLYKELEEFQNEIKIKTVVNNRRQSRTPK

SEQ ID NO: 491 - protein, 153 aa, Saccharomyces cerevisiae
  misc_feature (0)...(0): Polypeptide Accession Number YKL067W
MSSQTERTFIAVKPDGVQRGLVSQILSRFEKKGYKLVAIKLVKADDKLLEQHYAEHVGKPFFPKMVSFMKSGPILATVWEGKDVVRQGRTILGATNPLGSAPGTIRGDFGIDLGRNVCHGSDSVDSAEREINLWFKKEELVDWESNQAKWIYE

SEQ ID NO: 492 - protein, 169 aa, Saccharomyces cerevisiae
  misc_feature (0)...(0): Polypeptide Accession Number YKL070W
MYIPKHFESMELSRYKLSKKPPLGTLFSSKASRQGFFGWRTSSNKDDPDFGMCASHIPFVFVEFDNGEHKLIAHLARKNKHVEMLERVQKCLVVFQSVDSYISPAWFPMKKKTHKFVPTWDFAAVHVYGTPRIIRDDKDWLINMLSTLTDQEEEKRPEGENVRSKVERF

SEQ ID NO: 493 - protein, 450 aa, Saccharomyces cerevisiae
  misc_feature (0)...(0): Polypeptide Accession Number YKL075C
MAKDLLPKQAANEPSLKDCTCKRCLKLGASKEKKIRRKKKGEEKRERHYGNRRKLTFNFLKHTNMENTNYDVITSVGYLNEKYGLKKSHYIEKFIKCIHRKINIDVSKITDAYVNSLNPWVKVKLFLLLVTLSEKGGPEYWLDKTDGEKNSEASSTDNSLENSTKGADSAGSTALRDEMVKSHKNLFPTLTEQIIQHNINQDFTESTYDEDYVFSSIWANFMEGLINHYLEKVIVPYSEMKVCQQLYKPMMKIISLYNEYNELMVKSEKNGFLPSLQDSENVQGDKGEKESKDDAVSQERLERAQKLLWQAREDIPKTISKELTLLSEMYSTLSADEQDYELDEFVCCAEEYIELEYLPALVDVLFANCGTNNFWKIMLVLEPFFYYIEDVGGDDDEDEDNVDNSEGDEESLLSRNVEGDDNVVERHFKPDPRVITLEKICEVAARQKWI

SEQ ID NO: 494 - protein, 443 aa, Saccharomyces cerevisiae
  misc_feature (0)...(0): Polypeptide Accession Number YKL090W
MSMDNNDDHESKLSILMDMFPAISKSKLQVHLLENNNDLDLTIGLLLKENDDKSTVDNELHQLYDMFPQLDCSVIKDQFVINEKSVESTISDLLNYETLQKLKDNQANSPDSVKRNEKKNNWESTNDHIESIIKFTDAPKNIAQEYLAENGFDTVKAIIKIILDYYDKRDFKKDVDTFKVKRSPNTTVRGGRVQSSTGLAHVLKKGKESANVAQESLKRPRSYKHSLDSPQMVELNELVADNRDLKAINHEFLQKCLQFYDGDVVKVLNISSLLIEDDKNITKTWNFDEGFTLTSRDNCKQHLPKFSTPQISRRNEVGNTYKLPLHDKETPEGAVPVINNLFQTYRLDFHGFLPSEAVSTLKLALNKWWSKEVAERELNSHNINSYGSKVQFVSPLIVVTGRGIHSIGGISKVRLQVKSFLEKNHYIFWEESSYFRIEGKKKK

SEQ ID NO: 495 - protein, 514 aa, Saccharomyces cerevisiae
  misc_feature (0)...(0): Polypeptide Accession Number YKL103C
MEEQREILEQLKKTLQMLTVEPSKNNQIANEEKEKKENENSWCILEHNYEDIAQEFIDFIYKNPTTYHVVSFFAELLDKHNFKYLSEKSNWQDSIGEDGGKFYTIRNGTNLSAFILGKNWRAEKGVGVIGSHVDALTVKLKPVSFKDTAEGYGRIAVAPYGGTLNELWLDRDLGIGGRLLYKKKGTNEIKSALVDSTPLPVCRIPSLAPHFGKPAEGPFDKEDQTIPVIGFPTPDEEGNEPPTDDEKKSPLFGKHCIHLLRYVAKLAGVEVSELIQMDLDLFDVQKGTIGGIGKHFLFAPRLDDRLCSFAAMIALICYAKDVNTEESDLFSTVTLYDNEEIGSLTRQGAKGGLLESVVERSSSAFTKKPVDLHTVWANSIILSADVNHLYNPNFPEVYLKNHFPVPNVGITLSLDPNGHMATDVVGTALVEELARRNGDKVQYFQIKNNSRSGGTIGPSLASQTGARTIDLGIAQLSMHSIRAATGSKDVGLGVKFFNGFFKHWRSVYDEFGEL

SEQ ID NO: 496 - protein, 313 aa, Saccharomyces cerevisiae
  misc_feature (0)...(0): Polypeptide Accession Number YKL110C
MPLVLFTGYPCSGKTTLAKHLVQLLQSKIDATPSLSKYSITYHSDESLGIKHSDYITSQDERKLRSEIISAVKRDLSKNKIVIVDSLNYIKGFRYQLHCEVKNLSTTFCVIQTLCPPETIFEWNKTSNPNPWEPELLNQLIQRYEEPNSSNRWDSPLFAILTPQDNITDYIDDICKVVFQTSKSAKNSGHNDPLSKGLQKPNSATVLKPASQSNFIQVLDIETSKIIKTIMNHIKSLTSIGGVSNGTRVIVSEGITDINDDGCFFVDLPIGNVVTLAQLQRLKRQFINFNKLRDIDQDRIGPLFADYLNKNLN

SEQ ID NO: 497 - protein, 246 aa, Saccharomyces cerevisiae
  misc_feature (0)...(0): Polypeptide Accession Number YKL130C
MSKDKDIKVTPGTCELVEQILALLSRYLSSYIHVLNKFISHLRRVATLRFERTTLIKFVKKLRFYNDCVLSYNASEFINEGKNELDPEADSFDKVILPIASMFVKCVETFDLLNYYLTQSLQKEILSKTLNEDLTLTAESILAIDDTYNHFVKFSQWMIESLRIGSNLLDLEVVQFAIKCADEDGTNIGETDNIFLQEILPVNSEEEFQTLSAAWHSILDGKLSALDEEFDVVATKWHDKFGKLKN

SEQ ID NO: 498 - protein, 726 aa, Saccharomyces cerevisiae
  misc_feature (0)...(0): Polypeptide Accession Number YKL135C
MPPLDKRIKKFLKDSIRIAPKISGKGELSELRTGLVSQYPQTRKDAIKKTIQQMTLGKDVSSLFPDVLKNIATIDVEQKKLVYLYVMNYAETHPELCILAVNTFITDAQDPNPLIRCMAIRTMSMIRVDKILEYIETPLRRTLHDDNAYVRKTAVICVAKLFQLNKDLCVELGVVEDLVNALDDSNPLVIANATAALIEIHNMDMDAVDLSSLIQSHVSQFLLALNECTEWARIIILGTLSEYSAKDSLEAQDIIDRVTAHLQHVNPAVVLATIKVIVRNLPQIEYSSNSLIMKRLSSAFVSLMSTPPEMQYVALKNIRIILEKYPELLTKELRIFYVKFNDPLYVKLEKIDILVRLVDPSNLKQCTLLLTELKEYAMEYEPEFVSRAIQALSQLGIKYAQESFVSKVLDILLELLERQDTIKDDCCISLCDLLRHCPGNDKMAKQVCAVFNTWSNPEVLLQSDIAKCNYVWLLGQHPNNFSDLESKINIFIENFVQEEALTQMSLLMTIVRLHATLTGSMLQSVLELATQQTHELDVRDMAMMYWRCLSMPNNESLVNDLCQNKLPMISNTLEKFSPEVLEKLLMELGTISSIYFKPDSNRRKGKKYVQNIVKGKHIEELESMAKNEISSKANDDVLLDFDERDDVTNTNAGMLNTLTTLGDLDDLFDFGPSEDATQINTNDTKAVQGLKELKLGGDSNGISSGGKNNPDVSGGNIVSQDLLDLF

SEQ ID NO: 499 - protein, 219 aa, Saccharomyces cerevisiae
  misc_feature (0)...(0): Polypeptide Accession Number YKL142W
MSNEIELLQKQVSELQDLVKKQSLIISKTGERVLELQLDKQKHDVTDFDSKFSKSISKKSGSATQFDATDFATNEDLVELVKELQGELNFIEERSIRRLVNSLKKDDDDVIAPLPNADGDIPAISDGVFPKSLKEFKDIPDLKLVRLAKFYERLPPTLKEQEDFENFLEGKVEAFHINETTDEEISKELEKFSKDELDDAFNDVARYLGLSLRRGTEIW

SEQ ID NO: 500 - protein, 212 aa, Saccharomyces cerevisiae
  misc_feature (0)...(0): Polypeptide Accession Number YKL144C
MFILSKIADLVRIPPDQFHRDTISAITHQLNNKFANKIIPNVGLCITIYDLLTVEEGQLKPGDGSSYINVTFRAVVFKPFLGEIVTGWISKCTAEGIKVSLLGIFDDIFIPQNMLFEGCYYTPEESAWIWPMDEETKLYFDVNEKIRFRIEREVFVDVKPKSPKERELEERAQLENEIEGKNEETPQNEKPPAYALLGSCQTDGMGLVSWWE

SEQ ID NO: 501 - protein, 398 aa, Saccharomyces cerevisiae
  misc_feature (0)...(0): Polypeptide Accession Number YKL166C
MYVDPMNNNEIRKLSITAKTETTPDNVGQDIPVNAHSVHEECSSNTPVEINGRNSGKLKEEASAGICLVKKPMLQYRDTSGKYSLSDFQILRTLGTGSFGRVHLIRSNHNGRFYALKTLKKHTIVKLKQVEHTNDERRMLSIVSHPFIIRMWGTFQDSQQVFMVMDYIEGGELFSLLRKSQRFPNPVAKFYAAEVCLALEYLHSKDIIYRDLKPENILLDKNGHIKITDFGFAKYVPDVTYTLCGTPDYIAPEVVSTKPYNKSVDWWSFGVLIYEMLAGYTPFYNSNTMKTYENILNAELKFPPFFHPDAQDLLKKLITRDLSERLGNLQNGSEDVKNHPWFNEVIWEKLLARYIETPYEPPIQQGQGDTSQFDRYPEEEFNYGIQGEDPYMDLMKEF

SEQ ID NO: 502 - protein, 306 aa, Saccharomyces cerevisiae
  misc_feature (0)...(0): Polypeptide Accession Number YKL183W
MMKKKPKCQIARTKPSVENVIPYNQFKKTQPRFNGNFSALNNEEYIILFGGGRDLILGSLTPCSSSHLSNQANPQDTSEYGTDLFILNSCIIIWFNGLGYGLEIPYSSVLYHASRRLPDGREGLQLEILLTLERDEVLDMLYQSLAPQACEFDGEEAHAFTVRSVELTIRPKYSIYDRHYNNEIETLFTFENFGVNRGDDLVNNCNEALAVCMDLHGEDVQDQDQEQYQDPSMAFEGAQDLNATYSGLGDTLHGPPVYQNDGLADDLDGDLVMDNVVSRGGPEASMSMEFYANQNLAGRKNSRDNE

SEQ ID NO: 503 - protein, 632 aa, Saccharomyces cerevisiae
  misc_feature (0)...(0): Polypeptide Accession Number YKL204W
MELNDPSIISSSQFSGELSDSDTAAATHKSQQAISNLFQKLAKKGREEKPIGSVESSTDSSNISVATSGNNKESNKKKNKKTAMLNFSSLTDPITNYKPMDLQYKTYAYSMNELYHLKPSLASASYEEDPLISELVRSLPKRKFWRLRMGPPDQKHANNHHFNGNNGGGSWKAGYKNGKNDERRMSRTKNMQGGKRRSQQDDEEKKIDQEMLEMDKNLQLGGDVGHSIADFEDWKAKMKELELKKLSKSKGISNSTAIAPRESASHETPTDLRPVIPRGPSSITDFLNLKRQDKKEESSQQTPGIPVGQPSLSKTSIEQVNELETNSDLGKSSSSRFSSFFNKSATSLPSLDNNNQVPSSNVSVVNNDGNSTPHQSGSRLMSFFKESRSSTPNAESQLLSASDKDNGKMQTLPQFQQQPQQMQPMAFTQHPPNNNAFFNGLLNKGKSETSTPPPPPPGLIAHQGPQFPVMGVPPNFPQRMMPPPPGLVQFQKDSKDVNKKEDRQLRQNKNPNGTRNSKGKQEETATPDLPQQQYMPPPPPPGFFPMHPNFPNGPMPPLPQGFPIPPNGMLPVTGQQPQPPYPNMMLQGNFPPNFQQGFGSNSPMPIPSIINANGKNVTNQLPPGLNSKKNIK

SEQ ID NO: 504 - protein, 184 aa, Saccharomyces cerevisiae
  misc_feature (0)...(0): Polypeptide Accession Number YKR007W
MGAVLSCCRNHSGEENEALLREQQAGYGSQGNANDEYDAEQMRLKEHEHEQKLLAREQELRDIVANTNDKLIDISMINNSGIVIQGTDLQEALDKRQQEEGGDSREDERSAGDDNLSGHSVPSSGSAQATTHQTAPRTNTFTLLTSPDSAKISKEQLKKLHSNILNEIFSQSQVNKPGPLTVPF

SEQ ID NO: 505 - protein, 353 aa, Saccharomyces cerevisiae
  misc_feature (0)...(0): Polypeptide Accession Number YKR011C
MSKLETVYLYAGEEQPRVKLTCIKEGLTLTQVIKFVHSIQELYGIELQTSETITENLKIDCAPAYLKPNCIPHFYILEYEEISDTFFIWKSDGRWQLNKLSALLYVDNDANVVKNTSWKEVFQNDQRFKNYDKRAWLQNCLEKMNRDLSKLNVEQFWSQYDKICQSIAKQKKKQEQFNMEVFDNFKNIVSIAIIKTKVLSNKRLLTTTLKNYHNSMKKKYNIQEQNLKENSLASCSNNEPSASLESESRHFSPVNSLSPSSLSTDDEAVSTDYIYKGPESKPNVNFMHSSATNDLIKSNFESYFKLMAEDYETFDLRAWSRQRPRKFQLVEKKKITKNPPNSHHPHKNGKISF

SEQ ID NO: 506 - protein, 322 aa, Saccharomyces cerevisiae
  misc_feature (0)...(0): Polypeptide Accession Number YKR022C
MAIKKRNKIRLPSGSPEEVGIDGSAHKPMQQIKPLVSNDSEDDDNDICVLQPIKFKKVPKRDITFDGEQAIKEDNSHYEDLYHSKKNTNASTRNKDDLLILNMEDLMEGNHHLLSDSSEAGSSSEGEHISSIPTRGEIAKLKAQKSLSRRKISESDVTTERDYVKLLDSEDKREIMETIRLNGGLKRNNEKEITNFSDDEMQGFQDEMLALTDNQIAIQKDSKRKIIEKAINEVPYRTNEEWETQLLSKGNINKSNEKIITPLPVLFPDDDESGNSIERINEMVSKICLQRKKVEMRLQALEKTKIDLEKSKASLINKLIGN

SEQ ID NO: 507 - protein, 742 aa, Saccharomyces cerevisiae
  misc_feature (0)...(0): Polypeptide Accession Number YKR024C
MSDEDSMLLNFTTNEDTAGSSYKQAAKVTGGRWKDRRRMKMKLEGKTVSRKRKANTTGDEGIIPGRGENSIKKLHKESSYSSEEQEKYKGRNAHNTQGRTLPADSQFVSSLFTSNREITTAVNTNIHDENVAINPSNAPLKGDQFASLGVSSLLVSHLEQKMRIKKPTSIQKQAIPQIIGNAGKNDFFIHAQTGSGKTLSYLLPIISTILNMDTHVDRTSGAFALVIAPTRELASQIYHVCSTLVSCCHYLVPCLLIGGERKKSEKARLRKGCNFIIGTPGRVLDHLQNTKVIKEQLSQSLRYIVLDEGDKLMELGFDETISEIIKIVHDIPINSEKFPKLPHKLVHMLCSATLTDGVNRLRNVALKDYKLISNGTKKDSDIVTVAPDQLLQRITIVPPKLRLVTLAATLNNITKDFIASGQQSKTLRTIVFVSCSDSVEFHYDAFSGSDGHHKNLTGDSVRLLTKGNTMFPCFSDSRDPDVVIYKLHGSLSQQMRTSTLQHFARDNEATKGKHLIMFCTDVASRGLDLPHVGSVIELDPPFAVEDHLHRVGRTARAGEKGESLLFLLPGEEEKYMDYIQPYHPMGWELLKFDKEILMPAFKDVNVNRNDKFIRKDEKSSKNKDVGDKEYEWDTNATTWHLNIERRVVGDSAFKNLAVKGFISHVRAYATHISQEKKFFNVKFLHLGHLAKSFGLRERPKAMGLQSSKDGNSEKKPTKENSKNKMFRMARMAEKQIASEFNY

SEQ ID NO: 508 - protein, 282 aa, Saccharomyces cerevisiae
  misc_feature (0)...(0): Polypeptide Accession Number YKR025W
MSIDNKLFVTEEDEEDRTQDRADVEDESNDIDMIADENGTNSAIANEQEEKSEEVKAEDDTGEEEEDDPVIEEFPLKISGEEESLHVFQYANRPRLVGRKPAEHPFISAARYKPKSHLWEIDIPLDEQAFYNKDKAESEWNGVNVQTLKGVGVENNGQYAAFVKDMQVYLVPIERVAQLKPFFKYIDDANVTRKQEDARRNPNPSSQRAQVVTMSVKSVNDPSQNRLTGSLLAHKVADEEANIELTWAEGTFEQFKDTIVKEAEDKTLVALEKQEDYIDNLV

SEQ ID NO: 509 - protein, 305 aa, Saccharomyces cerevisiae
  misc_feature (0)...(0): Polypeptide Accession Number YKR026C
MSEFNITETYLRFLEEDTEMTMPIAAIEALVTLLRIKTPETAAEMINTIKSSTEELIKSIPNSVSLRAGCDIFMRFVLRNLHLYGDWENCKQHLIENGQLFVSRAKKSRNKIAEIGVDFIADDDIILVHGYSRAVFSLLNHAANKFIRFRCVVTESRPSKQGNQLYTLLEQKGIPVTLIVDSAVGAVIDKVDKVFVGAEGVAESGGIINLVGTYSVGVLAHNARKPFYVVTESHKFVRMFPLSSDDLPMAGPPLDFTRRTDDLEDALRGPTIDYTAQEYITALITDLGVLTPSAVSEELIKMWYD

SEQ ID NO: 510 - protein, 295 aa, Saccharomyces cerevisiae
  misc_feature (0)...(0): Polypeptide Accession Number YKR037C
MGESLDRCIDDINRAVDSMSTLYFKPPGIFHNAILQGASNKASIRKDITRLIKDCNHDEAYLLFKVNPEKQSVSRRDGKEGVFDYVIKRDTDMKRNRRLGRPGEKPIIHVPKEVYLNKDRLDLNNKRRRTATTSGGGLNGFIFDTDLIGSSVISNSSSGTFKALSAVFKDDPQIQRLLYALENGSVLMEEESNNQRRKTIFVEDFPTDLILKVMAEVTDLWPLTEFKQDYDQLYHNYEQLSSKLRFIKKEVLLQDDRLKTMSQYHPSSSHDVAKIIRKEKDEIRRLEMEIANLQE

SEQ ID NO: 511 - protein, 417 aa, Saccharomyces cerevisiae
  misc_feature (0)...(0): Polypeptide Accession Number YKR048C
MSDPIRTKPKSSMQIDNAPTPHNTPASVLNPSYLKNGNPVRAQAQEQDDKIGTINEEDILANQPLLLQSIQDRLGSLVGQDSGYVGGLPKNVKEKLLSLKTLQSELFEVEKEFQVEMFELENKFLQKYKPIWEQRSRIISGQEQPKPEQIAKGQEIVESLNETELLVDEEEKAQNDSEEEQVKGIPSFWLTALENLPIVCDTITDRDAEVLEYLQDIGLEYLTDGRPGFKLLFRFDSSANPFFTNDILCKTYFYQKELGYSGDFIYDHAEGCEISWKDNAHNVTVDLEMRKQRNKTTKQVRTIEKITPIESFFNFFDPPKIQNEDQDEELEEDLEERLALDYSIGEQLKDKLIPRAVDWFTGAALEFEFEEDEEEADEDEDEEEDDDHGLEDDDGESAEEQDDFAGRPEQAPECKQS

SEQ ID NO: 512 - protein, 291 aa, Saccharomyces cerevisiae
  misc_feature (0)...(0): Polypeptide Accession Number YKR055W
MNTLLFKRKGGNCGNESNIVSQGSPSSSNLPESPGTLDEKNLPRLPTPFARSLSTIPSYEQMKRTNKLPDYHLKIVVVGDGAVGKTCLLISYVQGTFPTDYIPTIFENYVTNIEGPNGQIIELALWDTAGQEEYSRLRPLSYTNADVLMVCYSVGSKTSLKNVEDLWFPEVKHFCPSTPIMLVGLKSDLYEADNLSDLVEPSSAESLAKRLGAFAHIQCSARLKENIDEVFETAIHTLLSDSLYAPREPTHTIKNPFKRNTTRSDIDSSTGDTSVSISGTKRLRKNKCIIM

SEQ ID NO: 513 - protein, 274 aa, Saccharomyces cerevisiae
  misc_feature (0)...(0): Polypeptide Accession Number YKR060W
MVESNDIIKSGLAEKALKALILQCEENPSLKNDKDIHIIINTGKKMGINRDNIPRIIPLTKYKLFKPRDLNILLITKDPSALYRETLTKDEHTSELFKEIISVKNLRRRFKGSKLTQLYKDFDLVVADYRVHHLLPEVLGSRFYHGSKKLPYMIRMSKEVKLKRQQMVEKCDPIYVRAQLRSICKNTSYIPNNDNCLSVRVGYIQKHSIPEILQNIQDTINFLTDKSKRPQGGVIKGGIISIFVKTSNSTSLPIYQFSEARENQKNEDLSDIKL

SEQ ID NO: 514 - protein, 328 aa, Saccharomyces cerevisiae
  misc_feature (0)...(0): Polypeptide Accession Number YKR062W
MSKNRDPLLANLNAFKSKVKSAPVIAPAKVGQKKTNDTVITIDGNTRKRTASERAQENTLNSAKNPVLVDIKKEAGSNSSNAISLDDDDDDEDFGSSPSKKVRPGSIAAAALQANQTDISKSHDSSKLLWATEYIQKKGKPVLVNELLDYLSMKKDDKVIELLKKLDRIEFDPKKGTFKYLSTYDVHSPSELLKLLRSQVTFKGISCKDLKDGWPQCDETINQLEEDSKILVLRTKKDKTPRYVWYNSGGNLKCIDEEFVKMWENVQLPQFAELPRKLQDLGLKPASVDPATIKRQTKRVEVKKKRQRKGKITNTHMTGILKDYSHRV

SEQ ID NO: 515 - protein, 193 aa, Saccharomyces cerevisiae
  misc_feature (0)...(0): Polypeptide Accession Number YKR068C
MVSTTQSRSLKAMGEEIWKNKTEKINTELFTLTYGSIVAQLCQDYERDFNKVNDHLYSMGYNIGCRLIEDFLARTALPRCENLVKTSEVLSKCAFKIFLNITPNITNWSHNKDTFSLILDENPLADFVELPMDAMKSLWYSNILCGVLKGSLEMVQLDCDVWFVSDILRGDSQTEIKVKLNRILKDEIPIGED

SEQ ID NO: 516 - protein, 133 aa, Saccharomyces cerevisiae
  misc_feature (0)...(0): Polypeptide Accession Number YKR083C
MDSIDEQIAIKRKELQSLQKITSLTDGLKIQLTELNEQIKEMGMNADSVAQLMNNWDSIINNISQASLGLLQYAEGDYEIGPWKDSKKKESEQSNETGLEAQENDKNDEDNDEDEDLVPLPETMVRIRVDGNE

SEQ ID NO: 517 - protein, 1195 aa, Saccharomyces cerevisiae
  misc_feature (0)...(0): Polypeptide Accession Number YKR096W
MPETSVQNPLRLSENENTRSMFLSASQQQRPSATPSFPRLVRNTTANLSLSDFQVLNPSSKRQNSNSVYDDINSSKRRISRPRFSDIEGKNNDHTYPERTTVKESEKNPSPRYVSSSKRALKRENSVGITQSSALISKSFSENGGSIAHEKWSPENMIKPLNVSQNSLAFVDAGSDEQSKSEIVGGFQRKSNNSQEINDKDNSARDQDFNNSGNNNNNNNHSSNNNDNNNNNNDDNNNNNNSNSRDNNNNSDDSNEREENDSCKPASNKRSGIALIQKLQELYKVIVKQEIELQERCSQLTNSQTTELKSLWTIYKINTDLVNNYVTFITTALLPSQPPHDLVIGQEIVEIYRIERRLWVYGTITFLDVLKNFSNFMDPEVCCQFITHVFVSLSTMISDIPSKYSITWLQRLGDLSRMAIALYPSSFIDWKLSAEHWYTEAMKYIYNHGKLYYHMSTVQQNTLEAFVNLGKSVFCQETFTPSPQYMQLVIDNIYQRAFVERNNGNLRNSLLIEYLKHSEAMLLPSFLESPDLQNVVLSYFIEKFGIDANGCNIFNAEDMFVQNPDFFKYFFRHGPSFAQSHILQIVGFGEPKNPFAILFELPKYLKERKDKKERKKSSNNDSSVTESSTGNSRNDNEDDDEIMSSTTSISDHDLLAEFFNDIDTLRRPILPSMLTNEAWLETLKFLNMTSLKCGIIVLRKFLHGPLGIALPHILPWIYFIISICLKSSQLSDPVSKEFWMIIVKRAFPWDTMVTFMNVLIVYLLDNQTSNSIIGDLCDDYDKLSLSELLELFNEGEELPEILGCWGTLWFDTICEKNTHSISSEDNFQEIGIKDYMALDSPTDGIIFDEKDENGEKFWKRACRTIFLFRELSRSFPIGVIIRNDPLIYRSSFQNTNILGSLVFKLEPLCNIHNNIPVLGALESIIDISEARSENNTDLHAVPELSVNEGDNIFHYVGYKKLRADYTCFDKNGEFLSASLYTTWYVPNSNNTNIEDNINYNSEKENEGLFLECIKSDYPEIDFKTTYFVFDATSWLRHSARIFKLAQNRLLRFAICLTTFQELRFLRKSKDENVMEAATRGIITIRQLYYENKVLPLRFTGNVATHIEENLEFEEQITWRTHVDEFVIESVMKAQEKLESASEPRLSPRRFNYVVLISDDDAMKKKAEEKEIKTLSTRFVFSLCTKLGEQRHLCTD

SEQ ID NO: 518 - protein, 811 aa, Saccharomyces cerevisiae
  misc_feature (0)...(0): Polypeptide Accession Number YKR099W
MSNISTKDIRKSKPKRGSGFDLLEVTESLGYQTHRKNGRNSWSKDDDNMLRSLVNESAKELGYENGLEDVKTIQQSNHLSKCIAWDVLATRFKHTVRTSKDVRKRWTGSLDPNLKKGKWTQEEDEQLLKAYEEHGPHWLSISMDIPGRTEDQCAKRYIEVLGPGSKGRLREWTLEEDLNLISKVKAYGTKWRKISSEMEFRPSLTCRNRWRKIITMVVRGQASEVITKAIKENKNIDMTDGKLRQHPIADSDIRSDSTPNKEEQLQLSQQNNPSLIKQDILNVKENESSKLPRLKDNDGPILNDSKPQALPPLKEISAPPPIRMTQVGQTHTSGSIRSKVSLPIEGLSQMNKQSPGGISDSPQTSLPPAFNPASLDEHMMNSNSISDSPKHAYSTVKTREPNSSSTQWKFTLKDGQGLSISNGTIDSTKLVKELVDQAKKYSLKISIHQHIHNHYVTSTDHPVSSNTGLSNIGNINGNPLLMDSFPHMGRQLGNGLPGLNSNSDTFNPEYRTSLDNMDSDFLSRTPNYNAFSLEATSHNPADNANELGSQSNRETNSPSVFYPQANTLIPTNSTATNNEIIQGNVSANSMSPNFNGTNGKAPSSTASYTTSGSEMPPDVGPNRIAHFNYLPPTIRPHLGSSDATRGADLNKLLNPSPNSVRSNGSKTKKKEKRKSESSQHHSSSSVTTNKFNHIDQSEISRTTSRSDTPLRDEDGLDFWETLRSLATTNPNPPVEKSAENDGAKPQVVHQGIGSHTEDSSLGSHSGGYDFFNELLDKKADTLHNEAKKTSEHDMTSGGSTDNGSVLPLNPS

SEQ ID NO: 519 - protein, 306 aa, Saccharomyces cerevisiae
  misc_feature (0)...(0): Polypeptide Accession Number YKR104W
MSSVERIKEYTDIPSESNGYISPPANWPQTGDVELKNLSLRYSPHSSKALDNVSFKVKAGTKVGIVGRTGAGKSSIIAAIYRLSDWENGTITIDNKDIKHIPLERLRNSISCIPQDPTLFDGTVRSNLDPFDRYSDVQIYGVLSKVGLIEECDELCLIFEQEQPNFSSHKLRNRFIDLNTVVKSGGSNLSQGQRQLLCLARSMLGARNIMLIDEATASIDYISDAKIQKTIRETMKNTTILTIAHRLRSVIDYDKILVMEMGRVKEYDHPYTLISDRNTIFYRLCRQSGEFENLFELAKVSFDNKR

SEQ ID NO: 520 - protein, 757 aa, Saccharomyces cerevisiae
  misc_feature (0)...(0): Polypeptide Accession Number YLL001W
MASLEDLIPTVNKLQDVMYDSGIDTLDLPILAVVGSQSSGKSSILETLVGRDFLPRGTGIVTRRPLVLQLNNISPNSPLIEEDDNSVNPHDEVTKISGFEAGTKPLEYRGKERNHADEWGEFLHIPGKRFYDFDDIKREIENETARIAGKDKGISKIPINLKVFSPHVLNLTLVDLPGITKVPIGEQPPDIEKQIKNLILDYIATPNCLILAVSPANVDLVNSESLKLAREVDPQGKRTIGVITKLDLMDSGTNALDILSGKMYPLKLGFVGVVNRSQQDIQLNKTVEESLDKEEDYFRKHPVYRTISTKCGTRYLAKLLNQTLLSHIRDKLPDIKTKLNTLISQTEQELARYGGVGATTNESRASLVLQLMNKFSTNFISSIDGTSSDINTKELCGGARIYYIYNNVFGNSLKSIDPTSNLSVLDVRTAIRNSTGPRPTLFVPELAFDLLVKPQIKLLLEPSQRCVELVYEELMKICHKCGSAELARYPKLKSMLIEVISELLRERLQPTRSYVESLIDIHRAYINTNHPNFLSATEAMDDIMKTRRKRNQELLKSKLSQQENGQTNGINGTSSISSNIDQDSAKNSDYDDDGIDAESKQTKDKFLNYFFGKDKKGQPVFDASDKKRSIAGDGNIEDFRNLQISDFSLGDIDDLENAEPPLTEREELECELIKRLIVSYFDIIREMIEDQVPKAVMCLLVNYCKDSVQNRLVTKLYKETLFEELLVEDQTLAQDRELCVKSLGVYKKAATLISNIL

SEQ ID NO: 521 - protein, 250 aa, Saccharomyces cerevisiae
  misc_feature (0)...(0): Polypeptide Accession Number YLL027W
MINTGRSRNSVLLAHRFLSTGGFWRGGTNGTMSRTINNVNPFKLKFIPKTVPAAADSVSPDSQRPGKKPFKFIVSNQSKSSKASKSPKWSSYAFPSRETIKSHEEAIKKQNKAIDEQIAAAVSKNDCSCTEPPKKRKRKLRPRKALITLSPKAIKHLRALLAQPEPKLIRVSARNRGCSGLTYDLQYITEPGKFDEVVEQDGVKIVIDSKALFSIIGSEMDWIDDKLASKFVFKNPNSKGTCGCGESFMV

SEQ ID NO: 522 - protein, 586 aa, Saccharomyces cerevisiae
  misc_feature (0)...(0): Polypeptide Accession Number YLL028W
MSDHSPISNKENHLLPSDSSRSSSSDMHSTGTTGTTGVEPVDFTGEGAKYTTATEGNGGADLAIQRTTTMNSAAESEVNITRRLTKILTGSVNEPDRVEVDYTNCAPMGGDRPYPPSLPSRDLYEVTFDGPNDPLHPFNWPMKKKVLLCLVLCLDSIAIAMCSSIFASAVPQICEIYHVIEVVAILGITLFVLGFAASPVIYAPLSELYGRKGVLVLSAFGFALFQFAVATAENLQTIFICRFFGGFIGAAPMAVVPAAFADMFDTNVRGKAIALFSLGVFVGPILSPVMGSYIAQRTTWRWLEYVVGCFASAVFVAIVLFFEETHHPTILVNKAKQMRKQSNNWGIHAAHEDVELSIKDIVQKTVTRPIIMLFVEPLLLFVTIYNSFVYGILYLLLEAYPLVFVEGYGFTENGELPYIALIIGMMVCAAFIWYMDNDYLKRCRAKGKLVPEARLYAMVIAGTVFPIGILWFCWTGYYPHKIHWMVPTVGGAFIGFGLMGIFLPCLNYIIESYLLLAASAVAANTFMRSAFGACFPLFAGYMFRGMGIGWAGLLLGLFAAAMIPVPLLFLKYGESIRKKSKYAYAA

SEQ ID NO: 523 - protein, 825 aa, Saccharomyces cerevisiae
  misc_feature (0)...(0): Polypeptide Accession Number YLL032C
MDNFKIYSTVITTAFLQVPHLYTTNRLWKPIEAPFLVEFLQKRISSKELKNTKAICHIDPSWVNLNASFIRDDMISIKATTDDMDLDAICRISLPLPMNTNDLTAELEKMKRILLDLSEKFNLELIITKEPAYFTPEQTGESKELCIYVHALGFRSNLMECEPQLLAFVDLIKKNGMTLPPQHYIIEPMELNSYSVLPLYMGVDMENFKHISRAFKTSIYAPSLITLSRDLKANPQIFFSGAVHSLSLLARKTLRESISVNSKSFFYRRLTNITPGKLLFIRKYYQQKVNQLILKYQSLIRVTNEYIEFQSISTNLLEMVIKNFTIQVLHEIVEVQISLNENCAMSPELIIDSFFGHTGNQIVVITPKEDSFNQLIVVGNQSSTDEASDTSILHYLSDFIMGSNQVINPNLRQIKAIFEIHPDFEDFISGKKNGKLTRIMELSACLIQLEMEEEDDNLYLNLVSDSFPDFKESFKNVINEFPAEESFFIPEVCHRPIIGTGGSLIQATMRKHNVFIQFSNSFNLPQNKISMIRYDNVIIRCPRKNKANICLAKNDLKQIVQEYDSLQSKTLIRFSSGQYRHILHVNGQKNIIGQIEKNENVYIMIPLKEPLDGTSQLSIQGNDENASRAANELVNSAFGYEYEFKIDQEIDPNKEYEFYNLIVVPFLQIMNIIVTFEKDLITFTFEKDTNENTLTKAIELLSNYLETQKTKIIFKKIIKKFVLGSASSKSNTSNSNTNGNFRSMNNAKSRTTIDNTSQSGASPQRHKMPVITTVGGAQAIKGYIPNTYYNGYGYGYGYTYEYDYNYANSNKAQTNNRHKYQNGRK

SEQ ID NO: 524 - protein, 249 aa, Saccharomyces cerevisiae
  misc_feature (0)...(0): Polypeptide Accession Number YLL046C
MLIEEIEFYNVNGKKTTTVVPENTKIKKRVLNDRRTLYVGNLPKNCRKQDLRDLFEPNYGKITINMLKKKPLKKPLKRFAFIEFQEGVNLKKVKEKMNGKIFMNEKIVIENILTKEEKSFEKNQKSNKKTAPDLKPLSTNTLYVKNIPMKSTNEDLAKIFGVDPKNINFVRRELVDLRTNKVFFSDEFHTGEAFIKFDNLGTGDSIQKKCREFKGRKASNGRVLLVKIASAKKNEQKQEGGDNTKIKQN

SEQ ID NO: 525 - protein, 179 aa, Saccharomyces cerevisiae
  misc_feature (0)...(0): Polypeptide Accession Number YLL049W
MPGLKLVEALEYRCDRLERLIGAGYSANSDVSVQLDELYNQLHRLYFQGLKYSQDLLQLFNTFMAEDIENVGAPDDICIFASCFDDIYTLYSAFDELNSQYMEFCQISKSSLDQISFKDANIETKQLKKLPELVDNCNIMILRSIAILNRFIDWNIEVNGFFQFQKKRLLNLQKVIYST

SEQ ID NO: 526 - protein, 412 aa, Saccharomyces cerevisiae
  misc_feature (0)...(0): Polypeptide Accession Number YLL057C
MSPAAAQTAIPLPSTDLPVKIITNGLKNLNYTSKQGYGNFDTHFYDGQDEVSPSGLLKIRKSYREKSKYPDYLPTWDPTEKYGPLEFHEYHDPALRADGNFSNLFAKENVGQLKVKKITPKLGLEINGIQLTDLSDAAKDELALLVAQKGVVVFRNQNFADEGPDYVTEYGRHFGKLHIHQTSGHPQNNPELHITFRRPDAEEFARVFDDSTSSGGWHTDVSYELQPPSYTFFSVVEGPDGGGDTLFADTIEAFDRLSKPLQDFLSTLHVIHSSKEQAENSQRQGGIKRRAPVTHIHPLVRVHPVLKKKCLYVNRAFSRKIVELKRQESESLLNFLYNLVESSHDLQLRAKWEPHSVVIWDNRRVQHSAVIDWEEPIHRHAFRITPQAERPVEDLKFLNDENYYPSSLTLDI

SEQ ID NO: 527 - protein, 324 aa, Saccharomyces cerevisiae
  misc_feature (0)...(0): Polypeptide Accession Number YLL062C
MKRIPIKELIVEHPGKVLILDGGQGTELENRGININSPVWSAAPFTSESFWEPSSQERKVVEEMYRDFMIAGANILMTITYQANFQSISENTSIKTLAAYKRFLDKIVSFTREFIGEERYLIGSIGPWAAHVSCEYTGDYGPHPENIDYYGFFKPQLENFNQNRDIDLIGFETIPNFHELKAILSWDEDIISKPFYIGLSVDDNSLLRDGTTLEEISVHIKGLGNKINKNLLLMGVNCVSFNQSALILKMLHEHLPGMPLLVYPNSGEIYNPKEKTWHRPTNKLDDWETTVKKFVDNGARIIGGCCRTSPKDIAEIASAVDKYS

SEQ ID NO: 528 - protein, 505 aa, Saccharomyces cerevisiae
  misc_feature (0)...(0): Polypeptide Accession Number YLR015W
MKLGIIPYQEGTDIVYKNALQGQQEGKRPNLPQMEATHQIKSSVQGTSYEFVRTEDIPLNRRHFVYRPCSANPFFTILGYGCTEYPFDHSGMSVMDRSEGLSISRDGNDLVSVPDQYGWRTARSDVCIKEGMTYWEVEVIRGGNKKFADGVNNKENADDSVDEVQSGIYEKMHKQVNDTPHLRFGVCRREASLEAPVGFDVYGYGIRDISLESIHEGKLNCVLENGSPLKEGDKIGFLLSLPSIHTQIKQAKEFTKRRIFALNSHMDTMNEPWREDAENGPSRKKLKQETTNKEFQRALLEDIEYNDVVRDQIAIRYKNQLFFEATDYVKTTKPEYYSSDKRERQDYYQLEDSYLAIFQNGKYLGKAFENLKPLLPPFSELQYNEKFYLGYWQHGEARDESNDKNTTSAKKKKQQQKKKKGLILRNKYVNNNKLGYYPTISCFNGGTARIISEEDKLEYLDQIRSAYCVDGNSKVNTLDTLYKEQIAEDIVWDIIDELEQIALQQ

SEQ ID NO: 529 - protein, 240 aa, Saccharomyces cerevisiae
  misc_feature (0)...(0): Polypeptide Accession Number YLR025W
MWSSLFGWTSSNAKNKESPTKAIVRLREHINLLSKKQSHLRTQITNQENEARIFLTKGNKVMAKNALKKKKTIEQLLSKVEGTMESMEQQLFSIESANLNLETMRAMQEGAKAMKTIHSGLDIDKVDETMDEIREQVELGDEISDAISRPLITGANEVDEDELDEELDMLAQENANQETSKIVNNNVNAAPISENKVSLPSVPSNKIKQSENSVKDGEEEEDEEDEDEKALRELQAEMGL

SEQ ID NO: 530 - protein, 270 aa, Saccharomyces cerevisiae
  misc_feature (0)...(0): Polypeptide Accession Number YLR046C
MATHTSKRRIHRWENNELSEENSTIIYFPARGLMWTHFPFVLGICLEFVGYVLKIVFINSPSISTFIAQSVLLLIAPSLYALSIFMLFSKMARLILMEAYMLIPAKFSTVSFVVADMIGRVLQAVGGGLLSSWNSRNTGRILIIVGLFIQIFCYTFLTFSQLFLHYKMKATPSKIVRDSNEWFQYNFILLAGILLVNGRTIVRVVQFLMGLQSYIGQHEWCLYVFDTVLMFLLPLIFLATFRARNLFKLQDKSVNIQLNKLLDKESVSED

SEQ ID NO: 531 - protein, 428 aa, Saccharomyces cerevisiae
  misc_feature (0)...(0): Polypeptide Accession Number YLR049C
MVNNIMHEYVPPSQRLFHSRHRITRNDLKEEALHSGTTDWTTILDTTIDKDTNLISYAVPIIDNFAIPRANSQGSPVAPSPNHRSTMYSSSSSSASSVFSDGLFTPNNNRNSSGSSSLVIRPQKNLSVDSLIQENKRKINSEKESLSLIANNNDETLCTHTDPSIQNLIKSETKRNILNLKFQNRNLFRRELKLEKFWSNLRSCHTSGDETDLLLVISKHNLYWFGIPNDFRLPIYKRCLYHYSELDEAGFFSQYANNSLYLAIRKCCNNEEQETLSRSIFINLTKNVTWLNSRFDDNKDNKNSYTVTEGKFYQDFPNLYYHLKDKLKLNVIMDFIKPVIRNFMTNALNKHKLDGIGLELLDILIVTTYYGPNKINAFLMDTFILNLLKQCHYKFFVSNISELVIQISKIDCDLVILLEDLRSRIDLD

SEQ ID NO: 532 - protein, 181 aa, Saccharomyces cerevisiae
  misc_feature (0)...(0): Polypeptide Accession Number YLR065C
MAGKAGRKQASSNAKIIQGLYKQVSLFLGMAIVRLFISRKVTIGQWIKLVALNVPMFVALYIIVLSGKPKYDGNRVVKQGIDLNDNTNLISYFFDLIYLSLFGNIGIIAFRTFKFWWCLLLCPIYAGYKLYGLKNMFMPGAQQTQADNRSKNANEGQSKSKRQMKRERRGETDSKIKYKYR

SEQ ID NO: 533 - protein, 1082 aa, Saccharomyces cerevisiae
  misc_feature (0)...(0): Polypeptide Accession Number YLR071C
MTTTIGSPQMLANEERLSNEMHALKNRSEQNGQEQQGPVKNTQLHGPSATDPETTATQKESLEMVPKDTSAATMTSAPPPALPHVEINQVSLALVIRNLTVFTMKELAQYMKTNVHTQANEPNSAKKIRFLQLIIFLRTQFLKLYVLVKWTRTIKQNNFHVLIDLLNWFRTTNMNVNNCIWALKSSLNSMTNAKLPNVDLVTALEVLSLGRPNLPTHNFKLSGVSNSMDMVDGMAKVPIGLILQRLKDLNLTVSIKIALMNIPKPLNSYHIKNGRIYFTVPNEFEIQLSTVNRQSPLFFVDLKLLFNTEAEQTVSAVTEATSTNGDSENNEENSSSNGNNLPLNKPRLEKLINEILLKSNDPLLSLYNFLHKYVLTLQLYMVHREFLKLANGGKFSKSNLIHNYDSKKSTITVRYWLNGKMDSKGKITIGIQRTTESLILKWDNQSASRAKNMPVIYNNIVSNIEGILDEIMFNHARIIRSELLARDIFQEDEENSDVLLFQLPTTCVSMAPIQLKIDLLSGQFYFRNPTPLLSNYASKINRAEGPEELARILQQLKLDKIIHVLTTMFENTGWSCSRIIKIDKPIRTQVNTGGESVVKKEDNKYAIAGNSTTNSDVSLLLQRDLFIRLPHWPLNWYLILSIISSKTSCVVEKRIGKIVSQRGKWNLKYLDNSNVMTVKLESITYQKIMILQRTILNRIINHMLIDSLNQLEIRNKICSSEMINEQKLPQYIIQGSNTNDNISIITLELESFLEGSKALNSILESSMFLRIDYSNSQIRLYAKFKRNTMMIQCQIDKLYIHFVQEEPLAFYLEESFTNLGIIVQYLTKFRQKLMQLVVLTDVVERLHKNFESENFKIIALQPNEISFKYLSNNDEDDKDCTIKISTNDDSIKNLTVQLSPSNPQHIIQPFLDNSKMDYHFIFSYLQFTSSLFKALKVILNERGGKFHESGSQYSTMVNIGLHNLNEYQIVYYNPQAGTKITICIELKTVLHNGRDKIQFHIHFADVAHITTKSPAYPMMHQVRNQVFMLDTKRLGTPESVKPANASHAIRLGNGVACDPSEIEPILMEIHNILKVDSNSSSS

SEQ ID NO: 534 - protein, 693 aa, Saccharomyces cerevisiae
  misc_feature (0)...(0): Polypeptide Accession Number YLR072W
MWGDSMRELGDAMDNELNAVKPVVEEGGMDGARKFIKGKSFQKSSTEHMLISPGRDGSVPLNGLKSSPADPHLSDVNSILDNHRGGGETALTSVNNIIMATSTNGDSDGVDGDAKRPSISNCSSRSSFFDTVLSTFSLKSNSQDTVTNEVKNIEVQFASEEANKKFRQMFKPLAPNTRLITDYFCYFHREFPYQGRIYLSNTHLCFNSTVLNWMAKLQIPLNEIKYLDKVTTNSSAISVETVTNRYTFSGFIARDEVFQLITRVWSKENLTNINDVLEVDERVSKKKGISSTPSSIFNNVSTNAYNDFISTTTTEPTSRASYMSENDMLIEEAIRSVDDYMGTPRASPSSSSSSSSSSSSLGSSTTYYCRPVYRLKPNAPFQYEGPFHVQETMDFPYKPEANNEYVLLERQFSVPPGLLFIMMFNEDNPVFELSFLKTQDSSNISHIGTFEKVNKDGQHYREFQYTKQLHFPVGPKSTNCEVAEILLHCDWERYINVLSITRTPNVPSGTSFSTRTRYMFRWDDQGQGCILKISFWVDWNASSWIKPMVESNCKNGQISATKDLVKLVEEFVEKYVELSKEKADTLKPLPSVTSFGSPRKVAAPELTMVQPESKPEAEAEISEIGSDRWRFNWVNIIILVLLVLNLLYLMKLNKKMDKLTNLMTHKDEVVAHATLLDIPAKVQWSRPRRGDVL

SEQ ID NO: 535 - protein, 392 aa, Saccharomyces cerevisiae
  misc_feature (0)...(0): Polypeptide Accession Number YLR082C
MSNFKNFTLNSFEDYYGKPSETPKMEEEKLEVTNVNASSSKKVHKSKKSTSKYDQKNVFRNSMTGIAQILPTKPVKIIEQNIDFANPKSFDLLQSTHTICFNKRINTTNTKLNVETHTSSDIDNDILHVGAPTDLGGNSNDEAETRQLRKFRWSNNKEKSLCEKLTVIYWALLLHTTKRASKRRPILCHQMIAEFFNRVYKEKSRVPITSRYIRDNLVAWVTQGKELHEKGWVGDAKTGDLQEQFNIATVKLYESAEDGRLSIGKDKPFREENTGSDSLVRAEEDSTAVTNENGHISSEKNLKKDRRESIRNQILTLDLNDEDFFQNVMKVLSAIDEPELRQYVIVISELVSMEMDDGKTVREKLRDVELNINRLQVDIKEIKEMLVTLINK

SEQ ID NO: 536 - protein, 648 aa, Saccharomyces cerevisiae
  misc_feature (0)...(0): Polypeptide Accession Number YLR098C
MMLEPSPPPLTTTVTPSLPSSLKKSVTDNDQNNNNVPRKRKLACQNCRRRRRKCNMEKPCSNCIKFRTECVFTQQDLRNKRYSTTYVEALQSQIRSLKEQLQILSSSSSTIASNALSSLKNNSDHGDAPNEKILKYGETAQSALPSSESNDENESDAFTKKMPSESPPPVGTNSIYPSNSLSIIKKKTDGSTRYQQQQVSLKNLSRSPLILRSLSLFFKWLYPGHYLFIHRETFLSAFFGDTNTKSYYCSEELVFAIAALGSLISYKSETELFQQSEVFYQRAKTIVLKKIFQLEDSSLAESSSSSKLAIIQTLLCLAFYDIGSGENPMAWYLSGLAFRIAHEIGLHLNPEAWSNVYEDELSIMDFEVRSRIYWGCYIADHLIAILFGRSTSLRLSNSTVPETDELPEIETGIEEYIYDPKVILSTANPLKKLIVLSRITEIFASKIFSPNETLLQRSEYLAKFNLEVYNWRRDLPPELQWTKRSLMEMTDFNPTIAYVWFHYYIVLISYNKPFIYEIKQSRELVEGYVDELYYLLKVWKNKFKTFEKATIYMIYSAILAIQCMKSNLIKKDRKQDFLNFLSAPTLNYELARKFIENSEDALHNSETMDLLGTLSHGNDFALEYNFDFTLLNEIDMLIGGNTNDGLSK

SEQ ID NO: 537 - protein, 265 aa, Saccharomyces cerevisiae
  misc_feature (0)...(0): Polypeptide Accession Number YLR102C
MNQNGDKNEGKLFQLPSLPPWKTPRFNKANFNNFTTPLRKRSTRVINDDSMPITGEVLEERTADDLYGINMDVDEVDYLNTLSHIEEEKQYDYSPFCERNTLRESRIDSFLKAERAAHCLVFHKVGHLDGIDSYRPDIDIMCGEEANKYDSANPEGNGSMLLESVPGCNKEDLERLSRREFVTNSKPNMRRLDDIINHETNALKSFWNDSGLVNSLQSHHLHEEYLLLQEELKNVYKIKCHDRVPIESLRDKCRRHYSNEDSSFL

SEQ ID NO: 538 - protein, 435 aa, Saccharomyces cerevisiae
  misc_feature (0)...(0): Polypeptide Accession Number YLR113W
MTTNEEFIRTQIFGTVFEITNRYNDLNPVGMGAFGLVCSATDTLTSQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFAEMIEGKPLFPGKDHVHQFSIITDLLGSPPKDVINTICSENTLKFVTSLPHRDPIPFSERFKTVEPDAVDLLEKMLVFDPKKRITAADALAHPYSAPYHDPTDEPVADAKFDWHFNDADLPVDTWRVMMYSEILDFHKIGGSDGQIDISATFDDQVAAATAAAAQAQAQAQAQVQLNMAAHSHNGAGTTGNDHSDIAGGNKVSDHVAANDTITDYGNQAIQYANEFQQ

SEQ ID NO: 539 - protein, 687 aa, Saccharomyces cerevisiae
  misc_feature (0)...(0): Polypeptide Accession Number YLR117C
MDTLEPTAVDTHVSAEQILRDVYKKGQKARGSTNIDILDLEELREYQRRKRTEYEGYLKRNRLDMGQWIRYAQFEIEQHDMRRARSIFERALLVDSSFIPLWIRYIDAELKVKCINHARNLMNRAISTLPRVDKLWYKYLIVEESLNNVEIVRSLYTKWCSLEPGVNAWNSFVDFEIRQKNWNGVREIYSKYVMAHPQMQTWLKWVRFENRHGNTEFTRSVYSLAIDTVANLQNLQIWSDMEVAKLVNSFAHWEAAQQEYERSSALYQIAIEKWPSNQLLKAGLLDFEKQFGDINSIEETISYKRKMEYETILSNNAYDYDTWWLYLDLISESFPKQIMQTFEKAIVDSRPKELSKNVQWKRYIYLWMRYICYVELELENSLLEEELFQRLIDDIIPHKHFTFSKIWLMYAKFLIRHDDVPKARKILGKAIGLCPKAKTFKGYIELEVKLKEFDRVRKIYEKFIEFQPSDLQIWSQYGELEENLGDWDRVRGIYTIALDENSDFLTKEAKIVLLQKYITFETESQEFEKARKLYRRYLELNQYSPQSWIEFAMYQTSTPTEQQLLDLAKLQSENVDEDIEFEITDENKLEARKVFEEAIVFFKEKDDKQGRLSILEALKDYEETYGTELDQETVKKRFPKVIKKVRLQNGVEEEFVDYIFPDDIDDDKPKPSKFLELAKKWKQEQAL

SEQ ID NO: 540 - protein, 508 aa, Saccharomyces cerevisiae
  misc_feature (0)...(0): Polypeptide Accession Number YLR121C
MKLQLAAVATLAVLTSPAFGRVLPDGKYVKIPFTKKKNGDNGELSKRSNGHEKFVLANEQSFYSVELAIGTPSQNLTVLLDTGSADLWVPGKGNPYCGSVMDCDQYGVFDKTKSSTFKANKSSPFYAAYGDGTYAEGAFGQDKLKYNELDLSGLSFAVANESNSTFGVLGIGLSTLEVTYSGKVAIMDKRSYEYDNFPLFLKHSGAIDATAYSLFLNDESQSSGSILFGAVDHSKYEGQLYTIPLVNLYKSQGYQHPVAFDVTLQGLGLQTDKRNITLTTTKLPALLDSGTTLTYLPSQAVALLAKSLNASYSKTLGYYEYTCPSSDNKTSVAFDFGGFRINAPLSDFTMQTSVGTCVLAIIPQAGNATAILGDSFLRNAYVVYDLDNYEISLAQAKYGTGKENVEVIKSTVPSAIRAPSYNNTWSNYASATSGGNIFTTVRTFNGTSTATTTRSTTTKKTNSTTTAKSTHKSKRALQRAATNSASSIRSTLGLLLVPSLLILSVFFS

SEQ ID NO: 541 - protein, 748 aa, Saccharomyces cerevisiae
  misc_feature (0)...(0): Polypeptide Accession Number YLR135W
MELQRAQRNLKFLQNEDYVNVTDQTNLNGESQNAYSLGMETQVPEMQFSLSSDDDSIGTQVKSVTAQKSPMTQETTKNDTERNKDVDKSCNPVSTSHPDLGGSNIEENIFINTQIQSRLDDAEEETNLKLKLEKFKYSFKSSNADDTHSNANVTAKRRPAIRKANSKLKTKPKTKRDPKIIKNITDFNINNYERSRTASLLKQLSGKHKKVLDIIKTQNEGNSDKPPRARNNKGEKATFDTYSEQEWKDIMKLLLQKFPQSEETDLNEVQKFLYGSEKSSNSLDNQESSQQRLWTASQLPPELPDEAIQPEQEERIRDTQSAVNFLSLSQVMDDKSEIMKDEESIIISRGDSTSSQEYGNGLEPQQPVGNVVGEDIELAVGTRINAFSLTDYKACKPMSVEVSRRCENSTDNDYDNISIVSDTTDETSTLFPLDQYRYVFIENDERPPLATDTIGSTQFFTPNTSPLDGIIDLTQESFKAVRSLISPLKVENNKTGVTSQASNQVQVPATRTPTIIPQKNLTTTLKTEEEKNNIGSSIRVKLLQESVVKLNPKLVKHNFYRVEANDSEEEETEFDDQFCIADIQLVDSSKISTKDSTQNPTTSNDIIDTSAASSIASPEKFCEIMMSQSMKELRQSLKTVGLKPMRTKVEIIQSLQTASQILSTANPDNKGEHGGVANFSKIEIFDHLTELIEAFPDFLERIYTFEPIPLNELIEKLFSAEPFVSQIDEMTIREWADVQGICLRNDKK

SEQ ID NO: 542 - protein, 273 aa, Saccharomyces cerevisiae
  misc_feature (0)...(0): Polypeptide Accession Number YLR150W
MSNPFDLLGNDVEDADVVVLPPKEIVKSNTSSKKADVPPPSADPSKARKNRPRPSGNEGAIRDKTAGRRNNRSKDVTDSATTKKSNTRRATDRHSRTGKTDTKKKVNQGWGDDKKELSAEKEAQADAAAEIAEDAAEAEDAGKPKTAQLSLQDYLNQQANNQFNKVPEAKKVELDAERIETAEKEAYVPATKVKNVKSKQLKTKEYLEFDATFVESNTRKNFGDRNNNSRNNFNNRRGGRGARKGNNTANATNSANTVQKNRNIDVSNLPSLA

SEQ ID NO: 543 - protein, 110 aa, Saccharomyces cerevisiae
  misc_feature (0)...(0): Polypeptide Accession Number YLR154C
MTKDAVNLDAYTVSFMPFYTEYQGPTEEFKDYKFEDTIYFRGKELKREKSATPSSSDNTTSNTFSNGAILSGNTITGKIVSVNNYEREGTDRNELARLQELISLIDVINQ

SEQ ID NO: 544 - protein, 491 aa, Saccharomyces cerevisiae
  misc_feature (0)...(0): Polypeptide Accession Number YLR190W
MNSPTMKSEQLTPKLSPMSFCLDDQRNAGSFQNLLNSPTKLKLDTGPIGNSLLYPTSLSKLSELSRGGRSKQRRGSDTMRSVSPIRFQFLNNTPKMLKPEYLSQTTSNLPLLSALLKNSKKTTSEGQNSNPDPLNIEKNIIKQSIKDKLEQLRSSESVAQVQKKERNPPSFEAKVCAEEPILRKNAEGLLPSYVPVPATPLEDPENHGVRKVEDKGLRVVSGGSTQCLSTEVNELPKDLNLDNLPTDNNGFVQYGLKGNNNNNRYSFISSTSTDYEPEWCDGQQHISMQMASMANAEEANSREKSNLDIKIKQLELEITELKLQNEKLVHSMTTNRYIEERFMLEVMKDPSIQAQRSQRDIERKVKQLEKKFFNCKKVLKKLTESSAVVATSTSKTEGNSARIPCPKTRLARVSVLDLKKIEEQPDSSSGTSSEEDHLTNDDTDANTSEDLNVAFEEEPTSAISTTASVQSGESKRGFQLNLPVQVEKKEK

SEQ ID NO: 545 - protein, 114 aa, Saccharomyces cerevisiae
  misc_feature (0)...(0): Polypeptide Accession Number YLR200W
MSELGAKYQQLQNELEEFIVARQKLETQLQENKIVNEEFDQLEEDTPVYKLTGNVLLPVEQSEARTNVDKRLEFIETEITRCEKNIRDKQEELEKMRSELIKLNNTAASTGPGR

SEQ ID NO: 546 - protein, 297 aa, Saccharomyces cerevisiae
  misc_feature (0)...(0): Polypeptide Accession Number YLR208W
MVVIANAHNELIHDAVLDYYGKRLATCSSDKTIKIFEVEGETHKLIDTLTGHEGPVWRVDWAHPKFGTILASCSYDGKVLIWKEENGRWSQIAVHAVHSASVNSVQWAPHEYGPLLLVASSDGKVSVVEFKENGTTSPIIIDAHAIGVNSASWAPATIEEDGEHNGTKESRKFVTGGADNLVKIWKYNSDAQTYVLESTLEGHSDWVRDVAWSPTVLLRSYLASVSQDRTCIIWTQDNEQGPWKKTLLKEEKFPDVLWRASWSLSGNVLALSGGDNKVTLWKENLEGKWEPAGEVHQ

SEQ ID NO: 547 - protein, 360 aa, Saccharomyces cerevisiae
  misc_feature (0)...(0): Polypeptide Accession Number YLR215C
MSSQEYTTFIDIPVTRAQVEHCSYSFWSSLYPKYVPKSIVLKSLPKKFIQYLEQDGIKLPQEENSRSVYTEEIIRNEDNDYSDWEDDEDTATEFVQEVEPLIDFPELHQKLKDALNELGAVAPKLNWSAPRDATWILPNNTMKCNEVNELYLLLNASNYIMHDLQRAFKGCVDGDDIKGLKFDLVLRQWCDMNPALEFRVFVKNAHIVGATQRDLNYYDYLDELSDTFKDLIDEIVHDVVLPKFPDKSFVLDVYIPRPFNKIFIVDINPFARKTDSLLFSWNEIAAIAPPKNDVEDYELRLVTRHNTGRFASKEHSENHVPQDLVEASLNPEAIRELTQKWKELLSQQAKEESSDSENET

SEQ ID NO: 548 - protein, 371 aa, Saccharomyces cerevisiae
  misc_feature (0)...(0): Polypeptide Accession Number YLR216C
MTRPKTFFDISIGGKPQGRIVFELYNDIVPKTAENFLKLCEGNAGMAKTKPDVPLSYKGSIFHRVIKDFMCQFGDFTNFNGTGGESIYDEKFEDENFTVKHDKPFLLSMANAGPNTNGSQAFITCVPTPHLDGKHVVFGEVIQGKRIVRLIENQQCDQENNKPLRDVKIDDCGVLPDDYQVPENAEATPTDEYGDNYEDVLKQDEKVDLKNFDTVLKAIETVKNIGTEQFKKQNYSVALEKYVKCDKFLKEYFPEDLEKEQIEKINQLKVSIPLNIAICALKLKDYKQVLVASSEVLYAEAADEKAKAKALYRRGLAYYHVNDTDMALNDLEMATTFQPNDAAILKAIHNTKLKRKQQNEKAKKSLSKMFS

SEQ ID NO: 549 - protein, 191 aa, Saccharomyces cerevisiae
  misc_feature (0)...(0): Polypeptide Accession Number YLR229C
MQTLKCVVVGDGAVGKTCLLISYTTNQFPADYVPTVFDNYAVTVMIGDEPYTLGLFDTAGQEDYDRLRPLSYPSTDVFLVCFSVISPPSFENVKEKWFPEVHHHCPGVPCLVVGTQIDLRDDKVIIEKLQRQRLRPITSEQGSRLARELKAVKYVECSALTQRGLKNVFDEAIVAALEPPVIKKSKKCAIL

SEQ ID NO: 550 - protein, 478 aa, Saccharomyces cerevisiae
  misc_feature (0)...(0): Polypeptide Accession Number YLR238W
MTGPGPEINKEEHPSSPGKKQITYNSIPKNANLIDGSTNSSKRPIEKYDKRIADPTKSYFPHSISRTPRRKYTYILVLTSLNGTFESKHVVIPFKPDGLKLGRPVANSNSSSSSSLRGGKRVDSHTFSQVRSDNGNFDSRVLSRNHALLSCDPLTGKVYIRDLKSSNGTFINGQRIGSNDVEIKVGDVIDLGTDIDTKIEHRKISATVEELFVQPLLESPIFENEDSDDCHTITEKEEAAAITSHIYGDSNNLELEEVILGSDTEILSGIFINNCIGTSPTLSNIIKTLAMEIPFSKCDNFKLQSMENFLINYTTHLEYTNKLLVEKNDQQLVKLQNGLRRKLSGKYEKIIEQNRNQVKQLERDHMFFKKSFEVKKRRNNEKQKSMEREIEDLKTRLEVERYKNSQMMKKNKQKEQELSTASKKKTTEHDTRGVPGMNPKGTDKFSIKNTLCNHFTLLTFGTISIGIIAIVFKILSPN

SEQ ID NO: 551 - protein, 272 aa, Saccharomyces cerevisiae
  misc_feature (0)...(0): Polypeptide Accession Number YLR243W
MSRVGVMVLGPAGAGKSTFCNSIISHMQTVGRRAHIVNLDPAAEATKYEFTIDIRDLISLDDVMEEMDLGPNGALIYCFEYLLKNLDWLDEEIGDFNDEYLIFDCPGQIELYTHIPVLPNIVRHLTQQLNFNLCATYLLEAPFVIDSSKFFSGALSAMSAMILLELPHINVLSKLDLIKGDINKKKLKRFLNPDAMLLMETEGMNQASNPKFLRLNQCIANLVDDFGMVQFLPLESNNPDSIETILSYVDDITQWAEGQEQKEPNDQIDVEE

SEQ ID NO: 552 - protein, 142 aa, Saccharomyces cerevisiae
  misc_feature (0)...(0): Polypeptide Accession Number YLR245C
MKVGGIEDRQLEALKRAALKACELSYSPYSHFRVGCSILTNNDVIFTGANVENASYSNCICAERSAMIQVLMAGHRSGWKCMVICGDSEDQCVSPCGVCRQFINEFVVKDFPIVMLNSTGSRSKVMTMGELLPMAFGPSHLN

SEQ ID NO: 553 - protein, 189 aa, Saccharomyces cerevisiae
  misc_feature (0)...(0): Polypeptide Accession Number YLR254C
MVPNLDLETAIQIISSLETQLSELEGATKEYENDLEQVISKLKSDLLESQQQNKCNKKQITDLEIQVDELENENIQLRNKIETLQLESDRRLERNVLLEHELLDTKEALQKLRVSKEEATSGETRRNTRSLPSQNKKMKLFKDTIKVSTTSSTLYLQNMAKTNNAARSHCNIPNTQITQSTVIATTSSV

SEQ ID NO: 554 - protein, 705 aa, Saccharomyces cerevisiae
  misc_feature (0)...(0): Polypeptide Accession Number YLR258W
MSRDLQNHLLFETATEVANRVGGIYSVLKSKAPITVAQYKDHYHLIGPLNKATYQNEVDILDWKKPEAFSDEMRPVQHALQTMESRGVHFVYGRWLIEGAPKVILFDLDSVRGYSNEWKGDLWSLVGIPSPENDFETNDAILLGYTVAWFLGEVAHLDSQHAIVAHFHEWLAGVALPLCRKRRIDVVTIFTTHATLLGRYLCASGSFDFYNCLESVDVDHEAGRFGIYHRYCIERAAAHSADVFTTVSQITAFEAEHLLKRKPDGILPNGLNVIKFQAFHEFQNLHALKKEKINDFVRGHFHGCFDFDLDNTLYFFIAGRYEYKNKGADMFIEALARLNYRLKVSGSKKTVVAFIVMPAKNNSFTVEALKGQAEVRALENTVHEVTTSIGKRIFDHAIRYPHNGLTTELPTDLGELLKSSDKVMLKRRILALRRPEGQLPPIVTHNMVDDANDLILNKIRQVQLFNSPSDRVKMIFHPEFLNANNPILGLDYDEFVRGCHLGVFPSYYEPWGYTPAECTVMGVPSITTNVSGFGAYMEDLIETNQAKDYGIYIVDRRFKAPDESVEQLVDYMEEFVKKTRRQRINQRNRTERLSDLLDWKRMGLEYVKARQLALRRGYPDQFRELVGEELNDSNMDALAGGKKLKVARPLSVPGSPRDLRSNSTVYMTPGDLGTLQEVNNADDYFSLGVNPAADDDDDGPYADDS

SEQ ID NO: 555 - protein, 67 aa, Saccharomyces cerevisiae
  misc_feature (0)...(0): Polypeptide Accession Number YLR264W
MDSKTPVTLAKVIKVLGRTGSRGGVTQVRVEFLEDTSRTIVRNVKGPVRENDILVLMESEREARRLR

SEQ ID NO: 556 - protein, 350 aa, Saccharomyces cerevisiae [sequence omitted]

SEQ ID NO: 557 - protein, 110 aa, Saccharomyces cerevisiae
  misc_feature (0)...(0): Polypeptide Accession Number YLR275W
MSSQIIDRPKHELSRAELEELEEFEFKHGPMSLINDAMVTRTPVIISLRNNHKIIARVKAFDRHCNMVLENVKELWTEKKGKNVINRERFISKLFLRGDSVIVVLKTPVE

SEQ ID NO: 558 - protein, 280 aa, Saccharomyces cerevisiae
  misc_feature (0)...(0): Polypeptide Accession Number YLR284C
MSQEIRQNEKISYRIEGPFFIIHLMNPDNLNALEGEDYIYLGELLELADRNRDVYFTIIQSSGRFFSSGADFKGIAKAQGDDTNKYPSETSKWVSNFVARNVYVTDAFIKHSKVLICCLNGPAIGLSAALVALCDIVYSINDKVYLLYPFANLGLITEGGTTVSLPLKFGTNTTYECLMFNKPFKYDIMCENGFISKNFNMPSSNAEAFNAKVLEELREKVKGLYLPSCLGMKKLLKSNHIDAFNKANSVEVNESLKYWVDGEPLKRFRQLGSKQRKHRL

SEQ ID NO: 559 - protein, 474 aa, Saccharomyces cerevisiae
  misc_feature (0)...(0): Polypeptide Accession Number YLR288C
MKLKLIVNGCEAPDDYKLLRTTINTVASLRKTAILRFNSERLTIISTPKSSLNSSNNGTILRGDTGQLWCTIPHDVFRLYTVISARELNTITMECNCDSLLSVFKRYDRVMNQGSSSNMTIKLQSMPEWNTNNGTLSGGTAGGVDTTSKPNPICALGITFEEIVHTSGPNDAIVMNGGVDEHNGLPTTVGTGNLLASNKVIMHSFKVPVKLLFRAQDTRIQEPMINYIQLMMYKLPPISGEFGSAFHGFIRRVERYSNVNHIHLMGVKKKEHGNEGDDVELKIIVNELDWHLEICWNGPLDSVIQRQEGLTDNPSQNQHIDTDGRQEEGSLPIIEADKPMSSLYTNTRDREMEENIRYDEDLLRIEDSSIADTRGNIYTADTSGDTEFNDISVMVEKAEQESSSTHEVIIRCKDWKVCSKLYAAFEEVVLAISHDESCVFHCSLDRGSLEDSEDVEKPRERGQIIYYIARSKGL

SEQ ID NO: 560 - protein, 381 aa, Saccharomyces cerevisiae [sequence omitted]

SEQ ID NO: 561 - protein, 219 aa, Saccharomyces cerevisiae
  misc_feature (0)...(0): Polypeptide Accession Number YLR293C
MSAPAANGEVPTFKLVLVGDGGTGKTTFVKRHLTGEFEKKYIATIGVEVHPLSFYTNFGEIKFDVWDTAGQEKFGGLRDGYYINAQCAIIMFDVTSRITYKNVPNWHRDLVRVCENIPIVLCGNKVDVKERKVKAKTITFHRKKNLQYYDISAKSNYNFEKPFLWLARKLAGNPQLEFVASPALAPPEVQVDEQLMQQYQQEMEQATALPLPDEDDADL

SEQ ID NO: 562 - protein, 109 aa, Saccharomyces cerevisiae
  misc_feature (0)...(0): Polypeptide Accession Number YLR294C
MMLRKPKKVIELFIASSLSKKKQTEPQAEQDHYFWLSSSHLFIFESSTIKKKQNTLRTLCNQPHKMQNLFFKQKIQLYIDTSLSFLLLLFFYFNNYYFLSMTYASLVNK

SEQ ID NO: 563 - protein, 444 aa, Saccharomyces cerevisiae
  misc_feature (0)...(0): Polypeptide Accession Number YLR303W
MPSHFDTVQLHAGQENPGDNAHRSRAVPIYATTSYVFENSKHGSQLFGLEVPGYVYSRFQNPTSNVLEERIAALEGGAAALAVSSGQAAQTLAIQGLAHTGDNIVSTSYLYGGTYNQFKISFKRFGIEARFVEGDNPEEFEKVFDERTKAVYLETIGNPKYNVPDFEKIVAIAHKHGIPVVVDNTFGAGGYFCQPIKYGADIVTHSATKWIGGHGTTIGGIIVDSGKFPWKDYPEKFPQFSQPAEGYHGTIYNEAYGNLAYIVHVRTELLRDLGPLMNPFASFLLLQGVETLSLRAERHGENALKLAKWLEQSPYVSWVSYPGLASHSHHENAKKYLSNGFGGVLSFGVKDLPNADKETDPFKLSGAQVVDNLKLASNLANVGDAKTLVIAPYFTTHKQLNDKEKLASGVTKDLIRVSVGIEFIDDIIADFQQSFETVFAGQKP

SEQ ID NO: 564 - protein, 1900 aa, Saccharomyces cerevisiae
  misc_feature (0)...(0): Polypeptide Accession Number YLR305C
MRFTRGLKASSSLRAKAIGRLTKLSTGAPNDQNSNGTTLDLITHTLPIFYSTNTSKIYTIPLTLSEWEVLTSLCVAIPTTLDLVETMLKEIIAPYFLETPRQRISDVLSSKFKLEQMRNPIELLTFQLTKFMIQACEQYPVLYENIGGIISTYFERVLKIFTIKQSGLLSLVGFINAFIQFPNSTELTKFTWKKLAKLVLRGSFLNEVDKILNSSATFTNDSIVQYYDAGNELSSAYLLELISRLQVSLISHLLNTSHVGANLSEFLLNQQYQFYKFDQEVADENDDTKCIDDFFFNVRSNKQFFTDMCKISLQFCSESHILDLSTDNRARFSFDTRAHYLQTLCLIPFIEDTESELFESFTNVVSESIDKFFLSDVVTPSLIKAIVASASLLNFFTEKLSLTLIRMFPLLVASPHITTETVNDVAKIFTTGLYPLNEDAIVSTIYSMNNLLAVSEDGSPVPVLRERQLTITSGKNIEKDYFPLRNSSASLDGTGALLGNTTVGQLSSHDVNSGATMTYHASLISNCVAATTTIASYYNTQSITALTISILTQKVNSMSKELDGVILNSLARLAPNTSLTEFSLLLKFFKSRTVIATKIDDSALLKNIIKAKCVISKELLARHFSSDLYFMYLHDLLDSIIASGEVERLEHHRPQTEISRVADQIATYLEPLAALLPVPGDTPLDINKDEVTTNKFRNAWFNFVIHGYHLGGPIVKRNFSFLLTIAYNSPPLASEFPANNKELSLEMNTILRRGSSNENIKQQKQQITEYFNTNIVQYRTTSSSKIMFLAAAVLLETIRCEAGDCSKTLLYFSDPSILSGSIEKCIAVLSVSMIRKYARLIQKGNDAIFNSKMIAQQLNNLLLCLSHREPTLQDAAFHACEIFIRSIPSSLCHHLSLYTLLDMLTALFDSILDSEAHKFEPRYEFKLKHSKTTILVPSSSSWRATTLSRLHKSAKEWVRILLNRSNQDTKILLQSYISDLGEYSRLNSVEFGVSFAMDMAGLILPADKELSRLTYYGPEKPNTISGFISLHSWRSKYLFDTAITSSPEDIKRQIGISTQNIRKNLTLGNKIITKDVTDFLDMATALLILGNGAPASLIYDIVHIPFEVFTSASLKIATNVWLTIITEKPEVAHLLLVEVCYCWMRSIDDNIGLYSRDHDLKGEEYQKMEYSPYDKAGINRDAKNASQAMQPHLHVIKFFASHFEGTLFQSDFLLKIFTKCALYGIKNLYKASLHPFARMIRHELLLFATLVLNASYKQGSKYMGRLSQEITNGALSWFKRPVAWPFGSNELKIKADLSVTRDLFLQLNKLSSLMSRHCGKDYKILNYFLASEIQQIQTWLTPTEKIEGADSNELTSDIVEATFAKDPTLAINLLQRCYSKKAEDVLVGLVAKHALMCVGSPSALDLFIKGSHLSSKKDLHATLYWAPVSPLKSINLFLPEWQGNSFILQFSIYSLESQDVNLAFFYVPQIVQCLRYDKTGYVERLILDTAKISVLFSHQIIWNMLANCYKDDEGIQEDEIKPTLDRIRERMVSSFSQSHRDFYEREFEFFDEVTGISGKLKPYIKKSKAEKKHKIDEEMSKIEVKPDVYLPSNPDGVVIDIDRKSGKPLQSHAKAPFMATFKIKKDVKDPLTGKNKEVEKWQAAIFKVGDDCRQDVLALQLISLFRTIWSSIGLDVYVFPYRVTATAPGCGVIDVLPNSVSRDMLGREAVNGLYEYFTSKFGNESTIEFQNARNNFVKSLAGYSVISYLLQFKDRHNGNIMYDDQGHCLHIDFGFIFDIVPGGIKFEAVPFKLTKEMVKVMGGSPQTPAYLDFEELCIKAYLAARPHVEAIIECVNPMLGSGLPCFKGHKTIRNLRARFQPQKTDHEAALYMKALIRKSYESIFTKGYDEFQRLTNGIPY

SEQ ID NO: 565 - protein, 398 aa, Saccharomyces cerevisiae
  misc_feature (0)...(0): Polypeptide Accession Number YLR312C
MSEEDDHWNLVRLRRLRKGREGEEQSSKSEISLDSLHESSFAGEDDEDFDADVLSNTSSEESAQMNRIYDFRTSNEFSNAGVNIDQTGVPTISESFDTLSGSNVGGTVLPSMEGSKLKDSTIRNSSTLSDHIIDKSEGKSAKLKMWHVIMLSSLLSMTFSYLALEYSLTGDVLAGFKSQQSLRNNERKLLYGNIDFVDKKSYDSSSDSLSQWAPSGKYYVDFDNHIAYPLKDDDLMGWRRYKTDLVILWYTTKARMKDGWHKRINKINGGRIKLHLFLKNSFKSAQESLRVLHKEQKRRWKRLFVLLHNKYRQFSPHIKRYFDHSCQKAKQCWSGSRLQLRKLRFKSMKPFRVFQFKVRKDTNWFVKQLKRFGLKLQHSRMYKAMSECRKKNYFKCKH

SEQ ID NO: 566 - protein, 153 aa, Saccharomyces cerevisiae
  misc_feature (0)...(0): Polypeptide Accession Number YLR315W
MNSEQLLHNYVSDSLLTTLISFQEFKQQLQSYTSDEQQLQHWYELLQARDARVTSELEARIKQFFITLRSRLLRFLESEQLSHSLSLETLIDALYKINDLLQQRLQILDDAIQEKTSELAEFENMVRSPSAGDNAIPGLLQIIQSYINLLEEN

SEQ ID NO: 567 - protein, 788 aa, Saccharomyces cerevisiae
  misc_feature (0)...(0): Polypeptide Accession Number YLR319C
MKMAVDDPTYGTPKIKRTASSSSSIETTVTKLLMSTKHLLQVLTQWSKGTTSGRLVSDAYVQLGNDFKVVSKFFMHAKVDMSDVGDVPMALRRVLEVTLREPPSDETLNKHLPKIREIIVTLLDKLKVKQAILKNMQQEHRISVKSHHQQNPSFTSNLSLGSEGTREGTPLSSRKSSIVRDQRQSDSVENSYGEKVNSTSTGTPSAQSAEATLTKPRTNIKQNLKSNNAPNASDDDDALSQLKKGTNLQRRASKRYSAYHMAKLTNQSTTEAAAAAGLMTTPSPSMLHLEETVRKSKLYGNNNNDDDRNINSAENKGKSIDDVSKASPLAKTPLPIENVRASPRRLSSVVTTSPDKAMNGTCPVFLRIGDKTKKCHVQLPTTKNALRLLFIERFAYSPGANSFPDIYIMDPQYGVFYELEELNLLDIKEGFVIELKLEENPNNTIKEFIDTVKMEISNSQNDIIRHLKEMSFGSAISGKQTEVLPQPGLEANKHDLVGQNKKDDDKTIKDIQYELGKIKQVHNINRSNINETIFNILRKVDNFKSLSFSAKNSSNRMYMEKSQTELGDLSDTLLSKVDDLQDVIEIMRKDVAERRSQPAKKKLETVSKDLENAQADVLKLQEFIDTEKPHWKKTWEAELDKVCEEQQFLTLQEELILDLKEDLGKALETFDLIKLCCEEQEKNPSRSKSNPILPIMRPGTFNQVREQVMVAVQSLNPDHDSRVEAIDKAEKMWEMERKLKASNEFDDELENFVGNSNLKKSGGFEEVERIRKQKDEANLRAYFGPGFT

SEQ ID NO: 568 - protein, 426 aa, Saccharomyces cerevisiae
  misc_feature (0)...(0): Polypeptide Accession Number YLR321C
MSHQNQLIPQAYISNFHNRLTNEDDGIPIFTMAQQTRQHKRAKVVNYAEYDNDLFDEFNMNGSNFNNADTHYKDNAVSHENTPALTNGVTMDGSEYNVLENMNGADSIISNNKYDAGSNMVVESLSGLNSNNNASNGPSNKAQAQDIGNAVLPDLQDQHHNPFNILRYPKIRDTFINGKVVSPYRLNTDQETKANANSGEAIMIPITLDIEHMGHTIKDQFLWNYNDDSISPEEFASIYCKDLDMTSATLQTQIANIIKEQLKDLENIAATEIMSDLHVIINLTCNLQDRFFEDNFQWNLNDKSLTPERFATSIVQDLGLTREFIPLISQSLHETILKIKKDWVDGHLIQDHVPNDAAFGYLSGIRLDIDELGSNWCPRVEILTKEEIQKREIEKERNLRRLKRETDRLSRRGRRRLDDLETTMRM

SEQ ID NO: 569 - protein, 104 aa, Saccharomyces cerevisiae
  misc_feature (0)...(0): Polypeptide Accession Number YLR322W
MRHCIIFIVCISIVEIRTVHIEFIKEIVVIFRIVDHFSPFMLPCLLSHCKDGDTIIFVCQSVMKVRNISLWNKLVLVRHCVLLCAFLLSFFNVLHSIISICRIF

SEQ ID NO: 570 - protein, 259 aa, Saccharomyces cerevisiae
  misc_feature (0)...(0): Polypeptide Accession Number YLR323C
MFRKRLVNKSSSDEKNQKKRQKINFSEEKLVASDEEKGSSDLMSLAKSGNSRTLQLSHENEGKLQKKGEDLDKYTLTVNDDSTKEDLLNFERKELAEKAKKRRPSDDNELVLNMSGKNKRLTKQINQPTNIRTTVLMDFQPDVCKDYKQTGYCGYGDSCKFLHSRDDFKTGWKLNQEWNADKEDSKAVTLDLEKIPFKCTLCKEDYKSPVVTNCGHYFCGSCFAKDMKKGTKCFICHKETHGSAKVASDLQKMLNKRKS

SEQ ID NO: 571 - protein, 523 aa, Saccharomyces cerevisiae
  misc_feature (0)...(0): Polypeptide Accession Number YLR324W
MSGNTTNVHETRAKFAETLQPRIGGNTTKVIRAALEKNEAESGVSEDNDNGSLEKVNVATSPLLTSTPPTISKALVKLYPYLILIDEFLNVVTWTGKNIWSSVLMLCLFITTVEYFETLVKYFGHLAIIAILWGYSLLDNYIEGTLSSSPTLEDIALLMNRVSLKSDILLSPMVNLGTQDIQRLLYTTVILSPIYVMITWLLLPPRSLMLMVGMFLLTYHSPWSKVARRLLWKFKIVRLLVFYVTGLDLGGINKDQGIFATVQKQVKKLASTENSNGVLSDSKPIRFTYVLYENQRRWLGIGWKPSMLSYERTPWTDEFLNEAPSPENFHLPEETNTMVWRWVDKTWRLDMTNDGAIQVPNSKARTSADPSPDEGFIYYDNTWKKPSKEDSFSKYTRRRRWVRTAELVKTSDFDESVINSNRNSAIEQKVEENSTNGLTAEQELGSNKQEKDNAKKVGEPTTEETKEFAEASNINEGEFERISSTDEEVLKSRARDRLAKVLDDTEEKEQSNPTIGRDSKKAV

SEQ ID NO: 572 - protein, 401 aa, Saccharomyces cerevisiae
  misc_feature (0)...(0): Polypeptide Accession Number YLR328W
MDPTRAPDFKPPSADEELIPPPDPESKIPKSIPIIPYVLADANSSIDAPFNIKRKKKHPKHHHHHHHSRKEGNDKKHQHIPLNQDDFQPLSAEVSSEDDDADFRSKERYGSDSTTESETRGVQKYQIADLEEVPHGIVRQARTLEDYEFPSHRLSKKLLDPNKLPLVIVACGSFSPITYLHLRMFEMALDAISEQTRFEVIGGYYSPVSDNYQKQGLAPSYHRVRMCELACERTSSWLMVDAWESLQPSYTRTAKVLDHFNHEINIKRGGVATVTGEKIGVKIMLLAGGDLIESMGEPNVWADADLHHILGNYGCLIVERTGSDVRSFLLSHDIMYEHRRNILIIKQLIYNDISSTKVRLFIRRAMSVQYLLPNSVIRYIQEHRLYVDQTEPVKQVLGNKE

SEQ ID NO: 573 - protein, 509 aa, Saccharomyces cerevisiae
  misc_feature (0)...(0): Polypeptide Accession Number YLR345W
MPNVLSDDEELLNGLGSEIMKPSRQGNHMARTVKRWVNKERATTADLKNVNIDGVHGPVNTESYISPGQLYSTDSGNLFHAGRILVVLVGLPATSKTLLSVAITRYTRWLGVRTKSFHFSEYKESAKNIPSDYFCVVPTSKEGVAFVEKLRMQMLNDILAFFNDLSGQLAIYDALNIRKIDRKNLETTFSEIGVKVLFIESIVSDQEIMNRNIALALESNDYKGLSTDEAIDEYMRRLSVNEPYYEMMTHDEELSYIKYINLGKQIIVKDNIHGYLVNKIVFFLMNLRQKKGCVYFARCGTSDKDNYIHDEELNEEGIHYSQVLKDFVLQRIKQKRQAKKNSDSLVEVIDGSHDEDLKTSLIVWTGPRKRTHDTALFFSKEGIKVQQRSELRQLNPGSIADLTDQQIMDKFPSEYKESLKDPYHFRFPRAESYHDLAVRMEPLLLEMEHTSKDILIIAHESTLRVLYGYLMACTCVELPNLNFTRDKLVEISFSPFCNTVELLNIPLTS

SEQ ID NO: 574 - protein, 807 aa, Saccharomyces cerevisiae
  misc_feature (0)...(0): Polypeptide Accession Number YLR352W
MPDLKSKTLSSQSLGAAIPPEIVYQILTYQFRDLLRNDHPGTAEKFNENLTTFVKSNLTVNKTFSHICQVLIYRYCNLTTAKRFHGLLQTLKGNRCLCNKIEVADFQELTSIGLGRSSEMNKMIKNLTNETLLEFLMLTKANLREFLACENIQDDLDDNIIKYILSPGKVLSVVDFCGCSGTTFTESFIKALDKYYPNKSIDQYRLEPIQQNYQITCLGLNDCIDLPSHVLWKILKMLPELQKLDLSHTSIDDSTLYHGIPHWKNLTHLSLATCLQVTPRAVLEFFSHHPTITDPDNTSTLEWLNVSVIAHSSSWNEVHTMFLLKKLCQHGHNKTLQYLNIGGLPLHVAPSFGEDPISESTYYYQCRDSLQFIKWNFPKLKSLSIKGNSIPISTLVEFLTPIDQDHPNCAQKLKFLNISGNSYVNKWTIQDSLLYTCSPSLVALEVSFDSWQQIEKLNDRHEIIAYRYKNPNSVIKDISTAEQVKWKCYIDSSYGRRYWLYKTDPFLNRDDLDSKSNLTRYDFEGHKIIEIINQPDFLKFAQSKIMLGCGLVPQSGIRRKLCYRDLKPPVSQFLNRKGAISLGDTPLPIITPTLPRGGWRIIHNEDDNNSHVEDSQNHVNAIPRRNSLLSRPTLRSNNGSSSANPFAINVSPASQIRDGLYWDRSVHDLRELSLQEQRIQELADEQQELRTIANFEETDDEYLHDPDLQRRRSQLHLFESSRSRSGNKTRPSLTGEHSSSASFLSFSHFNHLHKRKNYYFTHPDEFVYDPKDPLTTQRYRLHFEIVNEYQVFGCIERGMYRYYSLKA

SEQ ID NO: 575 - protein, 738 aa, Saccharomyces cerevisiae
  misc_feature (0)...(0): Polypeptide Accession Number YLR362W
MHKERPLNKASMIRSPVDEIYMEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVPTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQTATTAKADIWSTGCVVIEMFTGKHPFPDFSQMQAIFKIGTNTTPEIPSWATSEGKNFLRKAFELDYQYRPSALELLQHPWLDAHII

SEQ ID NO: 576 - protein, 242 aa, Saccharomyces cerevisiae
  misc_feature (0)...(0): Polypeptide Accession Number YLR376C
MEVLKNIRIYPLSNFITSTKNYINLPNELRNLISEEQESKLGFLHIIESDFKPSVALQKLVNCTTGDEKILIIDIVSIWSQQKQRQHGAIYMNSLSCINITGLIVFLELLYDSPMDALRRCQVDNFNFQLRGIVIDNLSFLNFESDKNYDVINLSKFEKLFKILRKLREFLGCWIITKSFPTDFYNGIENTLVDKWSIKRKSGVTLYPTKLPDSYMKGMDLIIYREVVDGRPQYRRIAALEE

SEQ ID NO: 577 - protein, 880 aa, Saccharomyces cerevisiae
  misc_feature (0)...(0): Polypeptide Accession Number YLR386W
MEKSIAKGLSDKLYEKRKAAALELEKLVKQCVLEGDYDRIDKIIDELCRDYAYALHQPMARNAGLMGLAATAIALGINDVGRYLRNILPPVLACFGDQNDQVRFYACESLYNIAKIAKGEILVYFNEIFDVLCKISADTENSVRGAAELLDRLIKDIVAERASNYISIVNNGSHGLLPAIKTDPISGDVYQEEYEQDNQLAFSLPKFIPLLTERIYAINPDTRVFLVDWLKVLLNTPGLELISYLPSFLGGLFTFLGDSHKDVRTVTHTLMDSLLHEVDRISKLQTEIKMKRLERLKMLEDKYNNSSTPTKKADGALIAEKKKTLMTALGGLSKPLSMETDDTKLSNTNETDDERHLTSQEQLLDSEATSQEPLRDGEEYIPGQDINLNFPEVITVLVNNLASSEAEIQLIALHWIQVILSISPNVFIPFLSKILSVLLKLLSDSDPHITEIAQLVNGQLLSLCSSYVGKETDGKIAYGPIVNSLTLQFFDSRIDAKIACLDWLILIYHKAPNQILKHNDSMFLTLLKSLSNRDSVLIEKALSLLQSLCSDSNDNYLRQFLQDLLTLFKRDTKLVKTRANFIMRQISSRLSPERVYKVISSILDNYNDTTFVKMMIQILSTNLITSPEMSSLRNKLRTCEDGMFFNSLFKSWCPNPVSVISLCFVAENYELAYTVLQTYANYELKLNDLVQLDILIQLFESPVFTRMRLQLLEQQKHPFLHKCLFGILMIIPQSKAFETLNRRLNSLNIWTSQSYVMNNYIRQRENSNFCDSNSDISQRSVSQSKLHFQELINHFKAVSEEDEYSSDMIRLDHGANNKSLLLGSFLDGIDEDKQEIVTPISPMNEAINEEMESPNDNSSVILKDSGSLPFNRNVSDKLKK

SEQ ID NO: 578 - protein, 112 aa, Saccharomyces cerevisiae
  misc_feature (0)...(0): Polypeptide Accession Number YLR390W
MDWLKNTTIVVLFSHSTDKSNKHKKRQVQCNMRKNTLDMVTIGIACLVGVYTGTRFFEPIVIDRLRKDGNLRTDIPIPEYDEDGNLLKVTPSLSSTPAAPPTPPTPPTPPQQ

SEQ ID NO: 579 - protein, 518 aa, Saccharomyces cerevisiae
  misc_feature (0)...(0): Polypeptide Accession Number YLR392C
MAPKISISLNPPYNGEFYSSNDQMSGIVSLQLTKALSIRKISVILKGFSETLTKIDQEYMFQQNGMMMPGQDNKSFHTLMKFEQRVFPPDNVWNALDGSSKPFKVKPGSYNYSFQFDKFPRKPECLKNHTAKTVAFVTRSNARLPPTFNSHWQEFNKIDNLDLYFYSFGKVIYMVQVQLELGKSSSWFKPFHKLIREIETFEFIPEPKDLIIEPDEDDNEELNAFSNNSRGNSMVTNNEFFNSSNLKVPSKDVKVVNGVGYIKSDRNFSQANSILIENGDIRSRPVSSVTSTRQSTRLVNGMKVFPSTYKMGLPDGESNMRIEVRSRDLKQIYRKDYLFRSGSQNFDKVYVVMEGNIASLSKMQITPLKLQLNLLETTTYLSQGIANGNYSSLKLIEIDLNQLKSNKPLLDLNEIRENFDGSMFECELRLKDHPILRKLVFNEEDYRHRGNRLYSFKTCTIKRTFSLQLLIEWGINGIRKQSEVNIDPVQIFCQVREHVEAEALPRYVPPPTYTEMAS

SEQ ID NO: 580 - protein, 683 aa, Saccharomyces cerevisiae
  misc_feature (0)...(0): Polypeptide Accession Number YLR403W
MDFTTMTMASNMATSTTTTATSAHASINSSSNFNIDIDSNQNTPSILINNNSDSSNGKNTDFNGVNNIHQKNIMNNTNNVHLYSPNIMDQTLLTPQDIAKLRRESIAHSQGMGGVSWGSISVGSWLRDEIISRRNSIVPASANGAASAAASATTTATNTLQIQQPTKRPSVSNPPYHRGYSISPQIAYTAYLPNLEKQYCKDYSCCGLSLPGLHDLLRHYEEAHISTSPNTTNMSQIPMNSAGNTSSSVRMTNNTSSANYNLQNNMAANTKNAGHKTNTMQAHSSNATNNTSINNMHANLQSNMDSNSTIRQSQHPHHQQNIIQQQLQSNSVNHTSGAVPTPSVMGSATASSTTANPNVISITGAPNSGLSMANHSQQLHLNGNLVDAVSTNDVFLRTSNSPSRHVPHNKQINSNNNSGININNNTSHNSNINMGSKNAMVNRPHTFNNYSLNKTSRNPIQHQSRKIDPHQTDLSPLVLVQDIDLSFMDDDILGPSNHNSMNSVVNPTTGSHNYNTFHSSVHAKSSQNMVEDQDIDDIDDDDDVDDDDDDDDDDDTENGSSSNGKSVHNNNYKMPQQAYIDDPARRLYVMDHEEQKPFKCPVIGCEKTYKNQNGLKYHRLHGHQNQKLHENPDGTFSVIDPDSTDSFGDGMGSAKDKPYRCEVCGKRYKNLNGLKYHRGHSTH

SEQ ID NO: 581 - protein, 566 aa, Saccharomyces cerevisiae
  misc_feature (0)...(0): Polypeptide Accession Number YLR417W
MEYWHYVETTSSGQPLLREGEKDIFIDQSVGLYHGKSKILQRQRGRIFLTSQRIIYIDDAKPTQNSLGLELDDLAYVNYSSGFLTRSPRLILFFKDPSSKDELGKSAETASADVVSTWVCPICMVSNETQGEFTKDTLPTPICINCGVPADYELTKSSINCSNAIDPNANPQNQFGVNSENICPACTFANHPQIGNCEICGHRLPNASKVRSKLNRLNFHDSRVHIELEKNSLARNKSSHSALSSSSSTGSSTEFVQLSFRKSDGVLFSQATERALENILTEKNKHIFNQNVVSVNGVDMRKGASSHEYNNEVPFIETKLSRIGISSLEKSRENQLLNNDILFNNALTDLNKLMSLATSIERLYKNSNITMKTKTLNLQDESTVNEPKTRRPLLILDREKFLNKELFLDEIAREIYEFTLSEFKDLNSDTNYMIITLVDLYAMYNKSMRIGTGLISPMEMREACERFEHLGLNELKLVKVNKRILCVTSEKFDVVKEKLVDLIGDNPGSDLLRLTQILSSNNSKSNWTLGILMEVLQNCVDEGDLLIDKQLSGIYYYKNSYWPSHI

SEQ ID NO: 582 - protein, 708 aa, Saccharomyces cerevisiae
  misc_feature (0)...(0): Polypeptide Accession Number YLR424W
MEDSDSNTDKKFFFKKRRIDSYNYSDEEDNNSSMNSDMTYTNDALKTSSGNAPTISKLTKTYGIGAKLLSSMGYVAGKGLGKDGSGITTPIETQSRPMHNAGLGMFSNTNSSNYHSENEDYLSSEDEVVEGIEQVKFNKTSTEVLGEALLNDSGDMTIVRTLRELRLAGVQLPESILKELDPLNAVPKPKKDVVVEILQELLGIEKSLEAIRQRTSPLEVQVKEYYGQERLLSELEVTLRDESKHVSLYDKIGAILKLSDDELIDRLTSCLLRKELLIEFDLDHLEKPNDILDELTQIIELLAYRMDTTSKFLNRTQTTIFKVIYPKLKKFWEGFDMTKSKIDSAITLLLDFQQVLSFIGCKEHIMEEFVYPKLLQELDNWELHDEVDHVSPRIWVLDFMVLIDDKIKDTIVDKIEAKFFAYCKNWYHRESFCITNSDIIFIKELICERRYYKILCKEFLPKFLDELWERHNDPIYELEDWKEKQEWKEKDSGFFYFMKKLRSYTHYFHPKQYELMMRGTFNNINKILYQWHLYSTVEDLHKSKWWLNWLMNTVFEHSLPTEIELSEIRKSYNIFAMSHRYHLDKSTLDEDFDLRQGLRNLMETQVIDDISQSEQEPTYTVQNIPLGKVSSSFKDVVEDYCLEKGYLISKIPNRYTQLPYGRDQDCIVPLFEIRNGKKKMEVALKHDILWVEDSSGTFKPIYLWALDL

SEQ ID NO: 583 - protein, 651 aa, Saccharomyces cerevisiae
  misc_feature (0)...(0): Polypeptide Accession Number YLR429W
MSGKFVRASKYRHVFGQAAKKELQYEKLKVTNNAWDSNLLKTNGKFIAVNWNASGGGAFAVIPIEEVGKAPDQVPLFRGHTAQVLDTDFDPFNDHRIASGSDDSKIGIWDIPENYKFHDHVDEDGEPIDIKPVKFLTGHARKVGHVLYHPVAENVLASSSGDYTVKLWNVETGKDMITLKHPDMVTSMSFSYDGNYLATVARDKKLRVWNIREEKIVSEGPAHTGAKNQRVVWLGNSDRLATTGFSKLSDRQIGIWDAFNIEKGDLGGFYTVDQSSGILMPFYDEGNKILYLVGKGDGNIRYYEFQNDELFELSEFQSTEAQRGFAVAPKRMVNVKENEVLKGFKTVVDQRIEPVSFFVPRRSEEFQEDIYPDAPSNKPALTAEEWFSGKSVEGPILVSMRSIYDGSAPSFHEAKRPQQPTTQETALEEKKEQPKVEKPISESEKEVKQEAPKSPSPLKSASSSSTINHVLKEDNSINKLLKKSSDIDQVNNAEDPSRDTSGWEEADDEPAPIKIETPVTPTETKKDRTPKVEPSKELKPEPVSIATDRKQEQSLPQEEKSSEKTKSPEQEKSATPPSSITAAKTAITASSKEEPSAARTSPKSLGLKKSVEKLSTLVLQLEDVVDKLTKANLDKDERLLKLEQKIGELSK

SEQ ID NO: 584 - protein, 523 aa, Saccharomyces cerevisiae
  misc_feature (0)...(0): Polypeptide Accession Number YLR432W
MAAVRDYKTALEFAKSLPRLDGLSVQELMDSKTRGGLTYNDFLVLPGLVDFPSSEVSLQTKLTRNITLNTPFVSSPMDTVTESEMAIFMALLGGIGFIHHNCTPEDQADMVRRVKNYENGFINNPIVISPTTTVGEAKSMKERFGFSGFPVTEDGKRNGKLMGIVTSRDIQFVEDNSLLVQDVMTKNPVTGAQGITLSEGNEILKKIKKGKLLIVDDNGNLVSMLSRTDLMKNQNYPLASKSATTKQLLCGAAIGTIDADKERLRLLVEAGLDVVILDSSQGNSIFQLNMIKWIKETFPDLEIIAGNVATREQAANLIAAGADGLRIGMGSGSICITQEVMACGRPQGTAVYNVCEFANQFGIPCMADGGVQNIGHITKALALGSSTVMMGGMLAGTTESPGEYFYQDGKRLKAYRGMGSIDAMQKTGTKGNASTSRYFSESDSVLVAQGVSGAVVDKGSIKKFIPYLYNGLQHSCQDIGYKSLTLLKENVQSGKVRFEFRTASAQLEGGVHNLHSYEKRLHN

SEQ ID NO: 585 - protein, 553 aa, Saccharomyces cerevisiae
  misc_feature (0)...(0): Polypeptide Accession Number YLR433C
MSKDLNSSRIKIIKPNDSYIKVDRKKDLTKYELENGKVISTKDRPIASVPAITGKIPSDEEVFDSKTGLPNHSFLREHFFHEGRLSKEQAIKILNMSTVALSKEPNLLKLKAPITICGDIHGQYYDLLKLFEVGGDPAEIDYLFLGDYVDRGAFSFECLIYLYSLKLNNLGRFWMLRGNHECKHLTSYFTFKNEMLHKYDMEVYDACCRSFNVLPLAALMNGQYFCVHGGISPELKSVEDVNKINRFREIPSRGLMCDLLWADPVENYDDARDGSEFDQSEDEFVPNSLRGCSFAFTFKASCKFLKANGLLSIIRAHEAQDAGYRMYKNNKVTGFPSLITMFSAPNYLDTYHNKAAVLKYEENVMNIRQFHMSPHPYWLPDFMDVFTWSLPFVGEKVTSMLVSILNICSEQELDPESEPKAAEETVKARANATKETGTPSDEKASSAILEDETRRKALRNKILAIAKVSRMFSVLREESEKVEYLKTMNAGVLPRGALARGTEGLNETLSTFEKARKEDLINEKLPPSLSEVEQEKIKYYEKILKGAEKKPQL

SEQ ID NO: 586 - protein, 249 aa, Saccharomyces cerevisiae
  misc_feature (0)...(0): Polypeptide Accession Number YLR435W
MKNFEIDIDEYQNDSNSLYLLQQEERWSPKKSAKNFYSDNPYGTMSTQYIDETAFVQAEQGKTNLMFSDEKQQARFELGVSMVIYKWDALDVAVENSWGGPDSAEKRDWITGIVVDLFKNEKVVDAALIEETLLYAMIDEFETNVEDDSALPIAVEVINIYNDCFNLNYNKVEKLYLEWQEKQRTKKSKRVVHIEGDDDEDDEDVEDYDDEDEDEEMDEVVPDLVSSKPEPIVDEDGFELVQPKGRRKH

SEQ ID NO: 587 - protein, 424 aa, Saccharomyces cerevisiae
  misc_feature (0)...(0): Polypeptide Accession Number YLR438W
MSEATLSSKQTIEWENKYSAHNYHPLPVVFHKAKGAHVWDPEGKLYLDFLSAYSAVNQGHCHPHIIKALTEQAQTLTLSSRAFHNDVYAQFAKFVTEFFGFETVLPMNTGAEAVETALKLARRWGYMKKNIPQDKAIILGAEGNFHGRTFGAISLSTDYEDSKLHFGPFVPNVASGHSVHKIRYGHAEDFVPILESPEGKNVAAIILEPIQGEAGIVVPPADYFPKVSALCRKHNVLLIVDEIQTGIGRTGELLCYDHYKAEAKPDIVLLGKALSGGVLPVSCVLSSHDIMSCFTPGSHGSTFGGNPLASRVAIAALEVIRDEKLCQRAAQLGSSFIAQLKALQAKSNGIISEVRGMGLLTAIVIDPSKANGKTAWDLCLLMKDHGLLAKPTHDHIIRLAPPLVISEEDLQTGVETIAKCIDLL

SEQ ID NO: 588 - protein, 345 aa, Saccharomyces cerevisiae
  misc_feature (0)...(0): Polypeptide Accession Number YLR447C
MEGVYFNIDNGFIEGVVRGYRNGLLSNNQYINLTQCDTLEDLKLQLSSTDYGNFLSSVSSESLTTSLIQEYASSKLYHEFNYIRDQSSGSTRKFMDYITYGYMIDNVALMITGTIHDRDKGEILQRCHPLGWFDTLPTLSVATDLESLYETVLVDTPLAPYFKNCFDTAEELDDMNIEIIRNKLYKAYLEDFYNFVTEEIPEPAKECMQTLLGFEADRRSINIALNSLQSSDIDPDLKSDLLPNIGKLYPLATFHLAQAQDFEGVRAALANVYEYRGFLETGNLEDHFYQLEMELCRDAFTQQFAISTVWAWMKSKEQEVRNITWIAECIAQNQRERINNYISVY

SEQ ID NO: 589 - protein, 102 aa, Saccharomyces cerevisiae
  misc_feature (0)...(0): Polypeptide Accession Number YLR465C
MDHPHKWHRKLVNCNSDFIFKSRGHFVSISSQLGQHNFTIFNRYHLKKRIVFQILVNSSLRFSEQNFSITQNEAGIWKQLFNSPQSFPHTDIPSEEGTKVIL

SEQ ID NO: 590 - protein, 1382 aa, Saccharomyces cerevisiae
  misc_feature (0)...(0): Polypeptide Accession Number YLR466W
MWKTLGRVEQLLPYASLILRNREVLFREPKRGIDEYLENDSFFQMIPVKYREIVLPKLRRDTNKMTAALKNKVAVAIDELTVPLMWMIHFAVGYPYRYPELQLLAFAGPQRNVYVDDTTRRIQLYTDYNKNGSSEPRLKTLDGLTSDYVFYFVTVLRQMQICALGNSYDAFNHDPWMDVVGFEDPDQVTNRDISRIVLYSYMFLNTAKGCLVEYATFRQYMRELPKNAPQKLNFREMRQGLIALGRHCVGSRFETDLYESATSELMANHSVQTGRNIYGVDSFSLTSVSGTTATLLQERASERWIQWLGLESDYHCSFSSTRNAEDVVAGEAASSDHHQKISRVTRKRPREPKSTNDILVAGRKLFGSSFEFRDLHQLRLCHEIYMADTPSVAVQAPPGYGKTELFHLPLIALASKGDVKYVSFLFVPYTVLLANCMIRLSRCGCLNVAPVRNFIEEGCDGVTDLYVGIYDDLASTNFTDRIAAWENIVECTFRTNNVKLGYLIVDEFHNFETEVYRQSQFGGITNLDFDAFEKAIFLSGTAPEAVADAALQRIGLTGLAKKSMDINELKRSEDLSRGLSSYPTRMFNLIKEKSEVPLGHVHKIWKKVESQPEEALKLLLALFEIEPESKAIVVASTTNEVEELACSWRKYFRVVWIHGKLGAAEKVSRTKEFVTDGSMRVLIGTKLVTEGIDIKQLMMVIMLDNRLNIIELIQGVGRLRDGGLCYLLSRKNSWAARNRKGELPPIKEGCITEQVREFYGLESKKGKKGQHVGCCGSRTDLSADTVELIERMDRLAEKQATASMSIIALPSSFQESNSSDRCRKYCSSDEDSDTCIHGSANASTNATTNSSTNATTTASTNVRTSATTTASINVRTSAITTESTNSSTNATTTASTNVRTSATTTASINVRTSATTTESTNSNTSATTTESTDSNTSATTTESTDSNTSATTTASTNSSTNATTTASTNSSTNATTTESTNASAKEDANKDGNAEDNRFHPVTDINKESYKRKGSQMVLLERKKLKAQFPNTSENMNVLQFLGFRSDEIKHLFLYGIDVYFCPEGVFTQYGLCKGCQKMFELCVCWAGQKVSYRRMAWEALAVERMLRNDEEYKEYLEDIEPYHGDPVGYLKYFSVKRGEIYSQIQRNYAWYLAITRRRETISVLDSTRGKQGSQVFRMSGRQIKELYYKVWSNLRESKTEVLQYFLNWDEKKCREEWEAKDDTVFVEALEKVGVFQRLRSMTSAGLQGPQYVKLQFSRHHRQLRSRYELSLGMHLRDQLALGVTPSKVPHWTAFLSMLIGLFYNKTFRQKLEYLLEQISEVWLLPHWLDLANVEVLAADNTRVPLYMLMVAVHKELDSDDVPDGRFDIILLCRDSSREVGE

SEQ ID NO: 591 - protein, 774 aa, Saccharomyces cerevisiae
  misc_feature (0)...(0): Polypeptide Accession Number YML006C
MQKSVRVGDYFDNDDNGLWSWYLTNLRLGDFEELIGNQLKYTLLKRFLNSHFYGDNNISARPNKKILLVSIPENVHEDISILEIFLKDYFHLEKLEHIQISKLTHSHCYNHENHYLLTDNLNNFQDPTFLEFASTSWQVQKNSKALNNNNRNSIPPPTISSSKASNGKLESNVSDDQWSNINTQTSTATRTNTNTRTLTSPDTVDINVTSVNSQSNNNDTPQDNENEVDEEDATSSIVLNFSHSRTVDSKPNRLPKIFPSYTNEDYTPSHSEIMSIDSFAGEDVSSTYPGQDLSLTTARREDESGQDEVEDHYSRVSHDLGDESIDQASYSMESSVSYTSYSSSSNSSSAHYSLSSSSRGNPKRENIDHTNATYVSELSSITSSIDNLTTSTTPEEEDNLIHHNYDAQGYGSGEDDGEEVYDDEDLSSSDYSVLSILPSISICDSLGYFRLVLQSILIQDPDTKEIFTAIRQSNNKPTMASVTDDWLLYDSNFSMNNLQILTLQDLLDIKRSFPKILFYTMVIVTNSGKQVEEEFKNPNYDNREGISKEQPLDSELSLTNDPQQYFPTAYNNGYNDYIDDEDDEDDGDDASLSEQSGPQMYIPTRMESNVTTAHRSIRTVNSIGEWAFNRHNSVTKIDKSNSNELDNSKTGESTVLSSEPHPMTQLSNSNTTSSNFSHSLKTKNSHKPNSKGNNESNSKNELKKIKSSINAMSAVERSKSLPLPTLLKSLSGIDNPTHATNKDRKRWKFQMNRFKNHKNSGSAGTDKSQRCAIM

SEQ ID NO: 592 - protein, 346 aa, Saccharomyces cerevisiae
  misc_feature (0)...(0): Polypeptide Accession Number YML015C
MTEPQGPLDTIPKVNYPPILTIANYFSTKQMIDQVISEDQDYVTWKLQNLRTGGTSINNQLNKYPKYKYQKTRINQQDPDSINKVPENLIFPQDILQQQTQNSNYEDTNTNEDENEKLAQDEQFKLLVTNLDKDQTNRFEVFHRTSLNKTQVKKLASTVANQTISENIRVFLQAVGKIYAGEIIELAMIVKNKWLTSQMCIEFDKRTKIGYKLKKYLKKLTFSIIENQQYKQDYQSDSVPEDEPDFYFDDEEVDKRETTLGNSLLQSKSLQQSDHNSQDLKLQLIEQYNKLVLQFNKLDVSIEKYNNSPLLPEHIREAWRLYRLQSDTLPNAYWRTQGEGQGSMFR

SEQ ID NO: 593 - protein, 196 aa, Saccharomyces cerevisiae
  misc_feature (0)...(0): Polypeptide Accession Number YML028W
MVAQVQKQAPTFKKTAVVDGVFDEVSLDKYKGKYVVLAFIPLAFTFVCPTEIIAFSEAAKKFEEQGAQVLFASTDSEYSLLAWTNIPRKEGGLGPINIPLLADTNHSLSRDYGVLIEEEGVALRGLFIIDPKGVIRHITINDLPVGRNVDEALRLVEAFQWTDKNGTVLPCNWTPGAATIKPTVEDSKEYFEAANK

SEQ ID NO: 594 - protein, 655 aa, Saccharomyces cerevisiae [sequence omitted]

SEQ ID NO: 595 - protein, 111 aa, Saccharomyces cerevisiae
  misc_feature (0)...(0): Polypeptide Accession Number YML032C-A
MIKRETRLRAKILGINANASSHNGECGNASSEITTVWIIEHMKNNLVTKWLNRVLHTSLKMVWYVYRGFNNSLGVCIICLPCNVLSSSQSHLLIAKESALPVSDSRCYYIL

SEQ ID NO: 596 - protein, 810 aa, Saccharomyces cerevisiae
  misc_feature (0)...(0): Polypeptide Accession Number YML035C
MDNQATQRLNDLSLEPAPSHDEQDGSGLVIDIDQRKIGDEQAGVVVDDETPPLEQQDSHESLAADSRNANFSYHENQQLLENGTKQLALDEHDSHSAILEQPSHSTNCSSSNIAAMNKGHDSADHASQNSGGKPRTLSASAQHILPETLKSFAGAPVVNKQVRTSASYKMGMLADDASQQFLDDPSSELIDLYSKVAECRNLRAKYQTISVQNDDQNPKNKPGWVVYPPPPKPSYNSDTKTVVPVTNKPDAEVFDFTKCEIPGEDPDWEFTLNDDDSYVVHRSGKTDELIAQIPTLRDYYLDLEKMISISSDGPAKSFAYRRLQYLEARWNLYYLLNEYQETSVSKRNPHRDFYNVRKVDTHVHHSACMNQKHLLRFIKHKLRHSKDEKVIFRDGKLLTLDEVFRSLHLTGYDLSIDTLDMHAHKDTFHRFDKFNLKYNPIGESRLREIFLKTNNYIKGTYLADITKQVIFDLENSKYQNCEYRISVYGRSLDEWDKLASWVIDNKVISHNVRWLVQIPRLYDIYKKTGIVQSFQDICKNLFQPLFEVTKNPQSHPKLHVFLQRVIGFDSVDDESKVDRRFHRKYPKPSLWEAPQNPPYSYYLYYLYSNVASLNQWRAKRGFNTLVLRPHCGEAGDPEHLVSAYLLAHGISHGILLRKVPFVQYLYYLDQVGIAMSPLSNNALFLTYDKNPFPRYFKRGLNVSLSTDDPLQFSYTREPLIEEYSVAAQIYKLSNVDMCELARNSVLQSGWEAQIKKHWIGKDFDKSGVEGNDVVRTNVPDIRINYRYDTLSTELELVNHFANFKRTIEEK

SEQ ID NO: 597 - protein, 212 aa, Saccharomyces cerevisiae
  misc_feature (0)...(0): Polypeptide Accession Number YML053C
MLSYYEHNTAFQTNNCNSGSNAATTYNSDANNDTIMNKRKNDHFEFDTHTFYQRSKRTKRDSVSTKFSVGSGCANLNNNNNNIIINNNNNNNNNNNNHNHNNSNNTATYNNIHYKKNIEICPLKPVSMHHTMNSRLLNESEFYSETEEYMIHGYFGNTNRDITGTSPTGSASIIQHQYHLLPSQSIIASQAPGTAMAALTNNNIANDYMDID

SEQ ID NO: 598 - protein, 464 aa, Saccharomyces cerevisiae
  misc_feature (0)...(0): Polypeptide Accession Number YML068W
MALTQFENDLEILRDMYPELEMKSVKVEEEGEFPQRINGKLLFKISLLADVNIEFGEQHMLLSNLSNECVEFTIYSCHYPDIRRCVVMDIKSLWISTDEKKMLIDKALRLVEETVDMSIEFADSFTSILILIFGFLIDDTAILLFPNGIRKCLTQDQYDLFKQISEEATLQKVSRSNYHCCICMEMEKGVRMIKLPCENANVEHYLCRGCAKSYFTAMIQENRISSVRCPQCEYKELKLEDFKSYKKMLKALFTPLIPVSFLKEVIDTELCERYEKMFYNQAATRLSKYCPYACVTCRRCDSWCTKEDLDDAMIQCQKCHFVFCFDCLHAWHGYNNKCGKKVSLSTDIIEEYLDDTVTSYERKRKLEAKYGRRVLELEVNDYLAEKMLDLAIKKEGSNLQRCPKCKVVVERSEGCNKMKCEVCGTLFCFICGVLLYPEDPYEHFREAYSGCYGRLFEGMPGTET

SEQ ID NO: 599 - protein, 668 aa, Saccharomyces cerevisiae
  misc_feature (0)...(0): Polypeptide Accession Number YML088W
MERPGLVLQDLPPEILINIFSHLDEKDLFTLQELSTHFRNLIHDEELWKNLFKSRVHTTHFPTFSQSSKFSVEYIERTRGLHHWQHNKAIRTKYTIIPTRNWDQPSIERIVFDYPRVAAYNDGTITILQLQNHKRQKKFKKLIYIPCTTPQGCSTMDFNINAAVFGRFDGRVFGKLLSNKSYLTPVMEFTGRHSAGVTAICNSESWDTSREDWSVSGSENGEIIWWCENKLVKMWKVSNRVIWKLAFFKDWTLIMDDEKLYIIHQMQELHSIDIPKDLDEQPMRVRFFKMDFGSMTLVLADLNNVYTISVNPNGNFGNLRKLEMPEQICAVEIDEKTSQREQNWQFAGDDGCYISLLTTQNTLYIINIRDLSSSGLKVQCKISFDEQVYVSQVTNLIVVVALPNVLQILNAMTGELIKTVLKTEKFPEFLKVSQDKIIMGSGNVLNYLKFVSSDSKKHHHSTKGKNTVSNKWNETLNTELQYYDEDEDLRRKRQSEISRLIDAYGGDLELSGDTDEENDIQLRIALLESQEAQARNQAEAGEPVGDDEDEQLRRALEESQLIYETQTNSSANHGNNTNDEIDEDDEEFLRAIRQSRVEDERRRHLRNHTTGRRNGPLSDDNFATYGAAESSERTSTENTIGSSVGVDASNNVDEDLQLAIALSLSEIN

SEQ ID NO: 600 - protein, 163 aa, Saccharomyces cerevisiae
  misc_feature (0)...(0): Polypeptide Accession Number YML094W
MSSQKIDLTKLNPEQLNAVKQQFDQELQHFTQSLQALTMAKGKFTECIDDIKTVSQAGNEGQKLLVPASASLYIPGKIVDNKKFMVDIGTGYYVEKSAEAAIAFYQKKVDKLNKESVQIQDIIKEKTQYSLSIEAQIRQAAIRQHEAMSKQQQQQQKKESSTA

SEQ ID NO: 601 - protein, 880 aa, Saccharomyces cerevisiae
  misc_feature (0)...(0): Polypeptide Accession Number YML099C
MGISSKNGPKKMGRAKTFTGCWTCRGRKVKCDLRHPHCQRCEKSNLPCGGYDIKLRWSKPMQFDPYGVPIPQNSPATTTNLSGSVDEPQYQRRNIDFVRYDEEYVYHEDMDDELTMLHTPPIEKISDNKTWIIKKFGVFKGTDKIDKQYAPRKKRNRKRVAKSLESSASISLSSLPSSSTISFPIRHIEDKLRNKGHVKTGILSANDGVPPTPNLLDYDWNNLNITGYEWISSELRDDALLSAVTLQGHHLGHTQPQEISLEENSNVVSGEEHVNAKEHGCAFEADNQGSSTLPNKAASANDKLYQQNLKLLFQKNSSNSEEPDPQALIDDVFVNIEPRSLPASDLNKITLAPPNEESRMPKSMLELTSYSSDLPPELVDIIPKTDLTVHGLARFLLNHYFNNVADKMTVVVLEKNPWKTLYFPRALMALGDLAGLGQSSNSRNALLNALLAVSCFHLQSKYPRNYKLQKYFLGLGIELRNQASNFLRLCLNTKSSIPEKYKDVLTAILSMNSIDVVWGTMADCQDHLALCEDFVESRMKLRPNISEKTKTLHRIFSFLKLIQDSTALDKVRAKEIVILPSEEDDNYKPLDTSNATTSSSEPRVDVVQEGLFREALNENDGKIHIEFVKEPITNVSADSTPSSTTPPIFTNIATESYYNKSDISKLVSKTDENIIGTDSLYGLPNSLILLFSDCVRIVRHNEYYNLTYLPVPRKFNELSLNFEKRLLKWKSEWNFHQENSEGKSFINSTAEALYHHTMSFYFSLIIYYFTMARSLNCQFLQNYVAKVLDHLNAMEELVDQKKVKIVPLIWQGFMAGCACTDENRQQEFRRWAAKLAESGVGSYWGARQVMLEVWRRRKEDEPGDNWYSVYKDWEMNLMLS

SEQ ID NO: 602 - protein, 942 aa, Saccharomyces cerevisiae
  misc_feature (0)...(0): Polypeptide Accession Number YML109W
MVLMEDMQNKDGHNTVENSSGGTDSNNNIQMRRMRKTQLSKKELFEKRKSDVLIAAKSLDTEIQNVKNLKRLSIGSMDLVIDPELEFKVNSRNSYSSDSSKESLQESLHEENIIRSEQKEEQGSEDNDAYEEGDATNVDDSIDITQTEYLHDEETLEKEKIIRNASSSTSSSARVTSRNRRLSGVKTLAHDVVLDVENDHDSKMVDLTQNLLWVPADQHPNVKPENYLELIQDTLQNIQISTNQDIDENKLELGNNHVISNRKRTGSVVRRPSRLKTSYTKFDDEPPLADKPQEGEIQVDKRISSSDIKTIRSVSLKEITEELTKISNNAGLTDSDAVTLARSLSMSGSFTNESLHLNGNHTENDNEFASNMFNETGLTIPERSSLRRSKFNTYKIRLEGSSLPQAVKLNSLMNIQTNDNRRSASSPASYTQVPQEQASLNDFHEIFDHYRRTSTDWSTENEKYVDSTNYYSDEEDLTHASISQESSLLSTDSSNNSVLIKPHNTGSMISEKLDQHVSSSEKSNTNNSEANHGWSWLNSSNGSLNANEQTYQQLTDDEDDEECVDNEKADFVNLSVSRRAKSTKRASERINHSKNRHSPIFQIHSEEAKSVVITPSVVSSSESQPSKPTAPAVVEKKVELPTDTQASTHKKNSLEKRLAKLFKRKQHNGTCKSDVKVIKKSVKKELKKKASHSSLSKFRKSPKKKPQEAEVERPSSPTKTITTEDIDTASVIEPEVRSSNASTLLPDSHTSHSSEFVVETISELDGDDSFDISGGDVNYDVEVHSSISRDTTAGLEEDIGAEREDNTSPTAPQISTLPPRKLTFEDVVKPDYSNAPIKFTDSAFGFPLPMITNSTVIMFDHRLGINVERAIYRLSHLKLSDPGRELRQQVLLSNFMYSYLNLVNHTLYMEQVGTGDIAFNGDSALGMMDKNDSDGTILIPDI

SEQ ID NO: 603 - protein, 510 aa, Saccharomyces cerevisiae
  misc_feature (0)...(0): Polypeptide Accession Number YML114C
MTSKTSESGTGTQSTIVQLRNLPDLTEISHLEIDAPVVEILKKTVLFQLNSLNICISNFALDELVNLVTVQMDGMFRNLHNLTLLQRRSQASQADLKLLLREFNLDAPSLYQQFQASEFIKSKHSTEYEKLMSWSSLAALPHNEEDEEDELNNIEEQQNEINVLLPPSNPLEKQIPSWLPNFPPDHTYKFTPEFNHPITDLKTIKKEIVKESQESEKALLNLNKSLSHISSASNTPQPPGLDDEDAIEQQLEIWGNALEERKPTITEKSFNENNIEQYAKYRVELARERVTKFEVNQLKRTKNPFLKISETLYLPESPHQSHKTIQKTIELQFRKSMTLFMHNLPKVQKLKKEKIRMAKEERAKSLKRRQEELISQRTKREQDEGHDLELLLNNEHARDAADDTTTPNALNNSTIVINTNAEDEDDDINLFGILGSSEDENEMSSMPAENLVAESEPPTMTAQDTTNTTPVAHNTTNIDATTSHSPHSTPNENAPTSPPADIATDHDITM

SEQ ID NO: 604 - protein, 357 aa, Saccharomyces cerevisiae
  misc_feature (0)...(0): Polypeptide Accession Number YML119W
MSPSPSVSPRRTLNNKSSYINNSGGLVLPPTQFNLNQQPVLSFQQKATFDSNQQFFYYPESPTKNLRPRFNSISQVNKGVNEDHYTGGGSSNNNRPSRYTNTMGAANTNVNSHPHHQSVSHLNSKSLKFNQTKEVSSINEIIFPSRTCTKKRYFTKPIDLYGTRSSTSVAPKLTNSPTKSKTNFNIKKCILPRSVVTTYKLPSPVHETIDDISKKIIILLISLKFEKNYHFLQPIQLSTNSKTRISKSLDELCGVQLTSTLRQQKQLQGNSKPVKNLPNSNAKQRAGASVSTNANESFELSFDGKAMDRSDIFRMVDSFSIAISDEDEEDEEEDSFQQRSANNRILPAEILSNEPLK

SEQ ID NO: 605 - protein, 310 aa, Saccharomyces cerevisiae
  misc_feature (0)...(0): Polypeptide Accession Number YML121W
MSSNNRKKLLLMGRSGSGKSSMRSIIFSNYSAFDTRRLGATIDVEHSHLRFLGNMTLNLWDCGGQDVFMENYFTKQKDHIFQMVQVLIHVFDVESTEVLKDIEIFAKALKQLRKYSPDAKIFVLLHKMDLVQLDKREELFQIMMKNLSETSSEFGFPNLIGFPTSIWDESLYKAWSQIVCSLIPNMSNHQSNLKKFKEIMNALEIILFERTTFLVICSSNGENSNENHDSSDNNNVLLDPKRFEKISNIMKNFKQSCTKLKSGFKTLILNNNIYVSELSSNMVCFIVLKDMNIPQELVLENIKKAKEFFQ

SEQ ID NO: 606 - protein, 511 aa, Saccharomyces cerevisiae
  misc_feature (0)...(0): Polypeptide Accession Number YMR004W
MDNYEGSDPWNTSSNAWTKDDDHVVSTTNSEPSLNGISGEFNTLNFSTPLDTNEEDTGFLPTNDVLEESIWDDSRNPLGATGMSQTPNIAANETVIDKNDARDQNIEESEADLLDWTNNVRKTYRPLDADIIIIEEIPEREGLLFKHANYLVKHLIALPSTSPSEERTVVRRYSDFLWLREILLKRYPFRMIPELPPKRIGSQNADQLFLKKRRIGLSRFINLVMKHPKLSNDDLVLTFLTVRTDLTSWRKQATYDTSNEFADKKISQEFMKMWKKEFAEQWNQAASCIDTSMELWYRITLLLERHEKRIMQMVHERNFFETLVDNFSEVTPKLYPVQQNDTILDINNNLSIIKKHLETTSSICKQETEEISGTLSPKFKIFTDILLSLRSLFERYKIMAANNVVELQRHVELNKEKLESMKGKPDVSGAEYDRIKKIIQKDRRSIIEQSNRAWLIRQCILEEFTIFQETQFLITRAFQDWAKLNSNHAGLKLNEWEKLVTSIMDMPISRE

SEQ ID NO: 607 - protein, 295 aa, Saccharomyces cerevisiae
  misc_feature (0)...(0): Polypeptide Accession Number YMR025W
MDLLKFSSLAISEINFLHESSFDSIDHSWFLLIGCKLDQDDEIYIPINGNEAESQWYIEKVIRIPMQENDKINQERLERRINLTKVTQKDICILGILDLCQLEEDENITNKVTEKVLTQLTALALKYLIKYNVFRQHTSFQEAVNSLKGYKIENSVQIGAEIILDFLQDKVQIKDVNDRYQIPTPNNTVDPGFDEFQLIDMKDKEINIQKYNNNTIRKLLEKINRMIIFLKNYDATDKPFSSTQDVILRKISMLVTQLQRGGTSDMNYLLDNKINEIKLLEISCKQWEISNMLKK

SEQ ID NO: 608 - protein, 292 aa, Saccharomyces cerevisiae
  misc_feature (0)...(0): Polypeptide Accession Number YMR039C
MSYYNRYRNKRRSDNGGGNLSNSNNNNGGMPSGLSASDAIFDLGKNKRVTVRQFRNINLIDIREYYLDSSTGEMKPGKKGISLTEDLYDELLKHRLNIDEALRRLGSKRPKTKMVRLLSDDEYEDDNNNDSTNNDKDKNGKDKNSPKKRREDKSKASNESHDLEPRSKKKKPAPPTLLPHEENIQNAEREANATLIIPGQAGRKQQEERKQKEKEEAEEAKAKAVAEQEKEAKAKEKIAEPEPEPVPTLQAKKEDIVSNINESKDANSSDEEFAQSLEAEMNKAEDDISEEE

SEQ ID NO: 609 - protein, 204 aa, Saccharomyces cerevisiae
  misc_feature (0)...(0): Polypeptide Accession Number YMR052W
MNSGGSDSFDYLLQLTKALSAECRANRQETDRIELLLKRLAKQSGISYDNLSKNIIPDSWKDNASQKASPPTEAQKLISENFKLIYEIEKQEYFNTKAVALINNINEHFSYIKNFIDEQNAIRERNIATFSSEKLDERNKSLQQNYESLKTENEETKKKLHSIIKQFEKLLKEVDWDRISKDSRDYSRFKKQLEYLQDTYQVLK

SEQ ID NO: 610 - protein, 426 aa, Saccharomyces cerevisiae
  misc_feature (0)...(0): Polypeptide Accession Number YMR068W
MLKEPSVRLREAIIEGNLLIVKRLLRRNPDLLTNIDSENGWSSLHYASYHGRYLICVYLIQLGHDKHELIKTFKGNTCVHLALMKGHEQTLHLLLQQFPRFINHRGENGRAPIHIACMNDYYQCLSLLIGVGADLWVMDTNGDTPLHVCLEYGSISCMKMLLNEGEVSLDDNVRDKGNWKPIDVAQTFEVGNIYSKVLKEVKKKGPPLGAGKKPSSFRTPILNAKATFEDGPSPVLSMNSPYSLYSNNSPLPVLPRRISTHTTSGNGGNRRSSITNPVFNPRKPTLSTDSFSSSSNSSSRLRVNSINVKTPVGVSPKKELVSESVRHSATPTSPHNNIALINRYLLPNKSNDNVRGDSQTATINDDGGGGNGGDATIGMGLRKDPDDENENKYKIKVNNGEPRRRVSLLNIPISKLRNSNNTRAED

SEQ ID NO: 611 - protein, 121 aa, Saccharomyces cerevisiae
  misc_feature (0)...(0): Polypeptide Accession Number YMR075C-A
MYVRRFYSDWFSGFSMFKNFNSSSFGLDSIIFFKYNRCFISSLEKSLNCIESSSFGTTTLVSSFKSHNFLKLLLLEADLLLLLLSLLLTWKYIKEAMSLTILSSLLPFWDPFDTNLSIKLS

SEQ ID NO: 612 - protein, 221 aa, Saccharomyces cerevisiae
  misc_feature (0)...(0): Polypeptide Accession Number YMR077C
MGQKSSKVHITKTDRAILEVKRSKDEIHKFTRRTDNLILVEKSQLKDLIRKNPENYKSNMKVRFLLKRIHYQEHLLQQASDQLINLENMVSTLEFKMVEKQFINGLKNGNEILKKLNKEFSNVDELMDDVQDQIAYQNEINETLSRSLVGTSNYEDDLDKELDALESELNPEKMNNAKVANMPSTEGLPSLPQGEQTEQKEREEFATEERSDTKEPLALLS

SEQ ID NO: 613 - protein, 304 aa, Saccharomyces cerevisiae
  misc_feature (0)...(0): Polypeptide Accession Number YMR079W
MVTQQEKEFLESYPQNCPPDALPGTPGNLDSAQEKALAELRKLLEDAGFIERLDDSTLLRFLRARKFDVQLAKEMFENCEKWRKDYGTDTILQDFHYDEKPLIAKFYPQYYHKTDKDGRPVYFEELGAVNLHEMNKVTSEERMLKNLVWEYESVVQYRLPACSRAAGHLVETSCTIMDLKGISISSAYSVMSYVREASYISQNYYPERMGKFYIINAPFGFSTAFRLFKPFLDPVTVSKIFILGSSYQKELLKQIPAENLPVKFGGKSEVDESKGGLYLSDIGPWRDPKYIGPEGEAPEAFSMK

SEQ ID NO: 614 - protein, 435 aa, Saccharomyces cerevisiae
  misc_feature (0)...(0): Polypeptide Accession Number YMR091C
MSDSEGGLASEVEHEKRSRSTSNRPNYAIDTEDLDIDENDENEDDDYREEEANEGVNEEEISDEEEQINKSGRNKRRHVDEEEDLSEDKGVTRSRNRSKFKKPVFPGIDDAEENLNPLKVVNEEYVLPDDPEGETKITADGDLLGGREFLVRTFTLTEKGNRKFMLATEPARIVGFRDSYLFFQTHPNLYKFILNQTQKNDLIDRGVLPYSYRNRQIALVTARGVFKEFGAKIIRGGKHITDDYYASELRTKGNVIEGKLAGDPIDKSARALETMMYPASENGINPAKNQVEFFEHRPHGHMSNSNIIASGSKLSSTNWLYQHSAACSRFNSDLFYDRVKVLLVDQQGLRDAYTNILHIPESTQSTTVLGWRRSKNDSPSDTSIVYETVIHDNDLNKPKTGLSEIPKEIYEDVVDEDVLRAITEQQNFEKCNEYI

SEQ ID NO: 615 - protein, 615 aa, Saccharomyces cerevisiae
  misc_feature (0)...(0): Polypeptide Accession Number YMR092C
MSSISLKEIIPPQPSTQRNFTTHLSYDPTTNAIAYPCGKSAFVRCLDDGDSKVPPVVQFTGHGSSVVTTVKFSPIKGSQYLCSGDESGKVIVWGWTFDKESNSVEVNVKSEFQVLAGPISDISWDFEGRRLCVVGEGRDNFGVFISWDSGNSLGEVSGHSQRINACHLKQSRPMRSMTVGDDGSVVFYQGPPFKFSASDRTHHKQGSFVRDVEFSPDSGEFVITVGSDRKISCFDGKSGEFLKYIEDDQEPVQGGIFALSWLDSQKFATVGADATIRVWDVTTSKCVQKWTLDKQQLGNQQVGVVATGNGRIISLSLDGTLNFYELGHDEVLKTISGHNKGITALTVNPLISGSYDGRIMEWSSSSMHQDHSNLIVSLDNSKAQEYSSISWDDTLKVNGITKHEFGSQPKVASANNDGFTAVLTNDDDLLILQSFTGDIIKSVRLNSPGSAVSLSQNYVAVGLEEGNTIQVFKLSDLEVSFDLKTPLRAKPSYISISPSETYIAAGDVMGKILLYDLQSREVKTSRWAFHTSKINAISWKPAEKGANEEEIEEDLVATGSLDTNIFIYSVKRPMKIIKALNAHKDGVNNLLWETPSTLVSSGADACIKRWNVVLE

SEQ ID NO: 616 - protein, 513 aa, Saccharomyces cerevisiae
  misc_feature (0)...(0): Polypeptide Accession Number YMR093W
MSTARPRIITSKAPLLPQQTTPEQRYWRQYTSAQLVKEHNSVTHISFNPQHPHDFAVTSSTRVQIFSSRTRQVIKTFSRFKDVVYSASFRSDGKLLCAGDATGLVSVYDSYNPRTILLSINASTHPTHVTKFHTQDNKILATASDDRVTRLWDISNAYEPQLELTGATDYVRTLSFIPAAPHLVATGSYDGLIRLYDTRSSGSTPIYSLNHDQPVENVIAVSPTQIVSCGGNNFKVWDLTSNKKLYERGNFNKAVTCLDYVENFDSPMQSALIASSLDGHVKVFDPLDNFQVKFGWKFSGPVLSCAVSPSTAQGNRHLVAGLSSGLLAIRTKKKEKRSSDKENAPASFNKNAKSNNFQRMMRGSEYQGDQEHIIHNDKVRSQRRMRAFERNINQFKWSEALDNAFVPGMAKELTLTVLQELRKRGKVRVALYGRDESTLEPLLNWCLKGIEDVRSASIVADWVAVVLELYGNTLESSPVLQELMIDLKTKVRHEIHKSKEAQRIEGMLQLLTS

SEQ ID NO: 617 - protein, 224 aa, Saccharomyces cerevisiae
  misc_feature (0)...(0): Polypeptide Accession Number YMR095C
MHKTHSTMSGKSMKVIGVLALQGAFLEHTNHLKRCLAENDYGIKIEIKTVKTPEDLAQCDALIIPGGESTSMSLIAQRTGLYPCLYEFVHNPEKVVWGTCAGLIFLSAQLENESALVKTLGVLKVDVRRNAFGRQAQSFTQKCDFSNFIPGCDNFPATFIRAPVIERILDPIAVKSLYELPVNGKDVVVAATQNHNILVTSFHPELADSDTRFHDWFIRQFVSN

SEQ ID NO: 618 - protein, 297 aa, Saccharomyces cerevisiae
  misc_feature (0)...(0): Polypeptide Accession Number YMR096W
MTGEDFKIKSGLAQMLKGGVIMDVVTPEQAKIAEKSGACAVMALESIPADMRKSGKVCRMSDPKMIKDIMNSVSIPVMAKVRIGHFVEAQIIEALEVDYIDESEVLTPADWTHHIEKDKFKVPFVCGAKDLGEALRRINEGAAMIRTKGEAGTGDVSEAVKHIRRITEEIKACQQLKSEDDIAKVAEEMRVPVSLLKDVLEKGKLPVVNFAAGGVATPADAALLMQLGCDGVFVGSGIFKSSNPVRLATAVVEATTHFDNPSKLLEVSSDLGELMGGVSIESISHASNGVRLSEIGW

SEQ ID NO: 619 - protein, 834 aa, Saccharomyces cerevisiae
  misc_feature (0)...(0): Polypeptide Accession Number YMR102C
MTNMAEDKTSISKVHSEFSNSSNTTGSEEESRSHQESFDGESSSGESKSKSKLNLEYSADIEPLKFRMTKTNNTNDKLKYSNNGNATDSFMRLKEHLQRGNTLNSNLRVNEFYPFNSIDTEQFENYLREPKYIKMLKRRKNLKQFRRLFLAQELMAYEGETVTSTSKSSEPTSKAIWSTKFSRDGKFMATGSKDGKIRIWKVIGSPVERAELDSSAESNKEARAKSMRIKQQVSSLNNPKEKQFLDSATEKYEEKEKLLNLYAPVFHPTPLRLYKEHVQDVLDINWSKNNFILSASMDKTVKLWHPDRKNSLKTFIHPDFVTCVEFHPTDDRFFISGCLDHKCRLWSILDDEVSFEYDCQDLITSVTLSPEEGKYTIIGTFNGYVHILMTRGLTPVSSFHVADRQTQEQNAHVMVTETDSKIRHGPRVTGLQAFRSQLDNSFRLVVTSNDSRIRIFDLEQRKLLEVLKGFHSGSSQHKAQLSIWHGQPIVVNSSDDHWVYGWRLKSSDRENDQDEPKRKPKGLARSGSLRSIFSKSMSRSSSQNNEEKPHHHLKLTNLLPLPHHSNDHYIKNTDYISFHAHNAPVTCVSIAPPETSKTLSLSNDVICELSLEFFQTSDSFDVLSRSNDDGIMSDVESSLGYNSKPGSISNASATSAIPDVVDAIGTILISTDNVGTIRVFRADMPSVIRKRVLLKLEEYNREVRRRFNSSDSLHSLSRSFNSRAKSNLAGQPAAAYTNTGKGYATGRGYSNICPKSSTSLKTLGSNAQPRTPRESMSSIFSNAHGPTTPTSAMNLPIRCNVCNGSRFEAFSGANDQQDRNYYCVDCGTVVNNFR

SEQ ID NO: 620 - protein, 131 aa, Saccharomyces cerevisiae
  misc_feature (0)...(0): Polypeptide Accession Number YMR112C
MQVLNTKSETKQENETMQPPYIQERLKSLNDIETQLCSMLQEASQVTFIFGELKRGNESVKPQFENHVKQFYERLDKSTTQLRKEIQLLDENVGTRLLPINVNKKALGQDTEKMEEQLDLLSAILDPSKSK

SEQ ID NO: 621 - protein, 213 aa, Saccharomyces cerevisiae
  misc_feature (0)...(0): Polypeptide Accession Number YMR117C
MSQKDNLLDNPVEFLKEVRESFDIQQDVDAMKRIRHDLDVIKEESEARISKEHSKVSESNKKLNAERINVAKLEGDLEYTNEESNEFGSKDELVKLLKDLDGLERNIVSLRSELDEKMKLYLKDSEIISTPNGSKIKAKVIEPELEEQSAVTPEANENILKLKLYRSLGVILDLENDQVLINRKNDGNIDILPLDNNLSDFYKTKYIWERLGK

SEQ ID NO: 622 - protein, 1337 aa, Saccharomyces cerevisiae
  misc_feature (0)...(0): Polypeptide Accession Number YMR129W
MEHRYNVFNDTPRGNHWMGSSVSGSPRPSYSSRPNVNTTRRFQYSDDEPAEKIRPLRSRSFKSTESNISDEKSRISERDSKDRYINGDKKVDIYSLPLISTDVLEISKQRTFAVILFLIIQCYKIYDLVILKSGLPLSGLLFKNYRFNFISKYFIIDSFFLYVLPSFNIPRLTFKPWVVYLQILAMLLLNIFISSDHEFVLISLIMTTWRKLYTKELSVTGSAINHHRIFDSSAHFKGALTIKILPENTAMFNPLHESYCLPMDTNLFKINSIDVPIRINSTEEIEYIELEYRDLYTNSVELRSLSKKDFKIIDNPKSFLKKDQSVLKSHSNDFEEGSTIRYLAVTLQDIGFYQIKKIVDSKKLNLKIHQSHLVVPYCPIASITGTGSNDRCIGDSDNVSFEIQGVPPMKLAYSKIVNGQTFSYVDSSLQPEYFESPLQSSKSKQSFTQGELNDLKWGRNQPVNINLDSSITQDGKFAYKIDKITDGLGNVVDFTSLPEELKKRYDLSYNFNVHEVPRAALEERFDPKSPTKRSIAIVFEEIKNWISDIPYVISLSYTDAQDKSKKIMNVTTDSLTKVLQADLPGSYNLEYIESKFCPGEIVGKSNVLVTMPVAPTMEVKSFPILDQCVGQVGLNFELSFTGAPPYYYNTKIYKLENGERKLYDAKRYTSEGTRNRFSYSPPKEGNYEIVFDTVSNKLFTEPIKLEPVKEYTFKTSMRVKPSASLKLHHDLKLCLGDHSSVPVALKGQGPFTLTYDIIETFSSKRKTFEIKEIKTNEYVIKTPVFTTGGDYILSLVSIKDSTGCVVGLSQPDAKIQVRRDIPSAAFNFFEPIKEAKIKHGSVTEIPLKLSGEGPFTVKFKHMDYDGNIVKEFENKFQNSYKPALKVSKEGLYQLVDIRDSSCQGNVIYRNSLYKVSFLEKPKFAIQDNHHITKVTENLFSKEEVCQGMEGTVDLALFGSPPFILEYDLMAPNGHISTKKIQVATKYASLKLPNQIPGEYITTIKAIFDGNYGESDIHFREHQSELIIKQTVHPIPDVAFADGGKTLRACAANVDQISFLEPINLKFLQGESPFSITFSVYHESTSRTDQYTIDNIDSENFSFEKLYEGMKLGNHAITIDSVVDANGCVNSLISGPRNQILVSITDAPKIHILDPSTEYCVGDYVAYQLNGVAPFMIKYEFNGIPLKSKERSSQFVRLASEPGIISITSLQDSSSQCIVDFTNPKLKSEFDDLSLNIHPIPSVTVSQGNYVTEDIREGDQAEVIFSFEGTPPFSLTYVRTEETDGKHGKRRSQVVETHKVTDIYSHEYKVITSLQGTYEAIEITDAYCFAKNDLFFNN

SEQ ID NO: 623 - protein, 370 aa, Saccharomyces cerevisiae
  misc_feature (0)...(0): Polypeptide Accession Number YMR139W
MNIQSNNSPNLSNNIVSKQVYYAHPPPTIDPNDPVQISFPTTEVVGHGSFGVVFATVIQETNEKVAIKKVLQDKRFKNRELEIMKMLSHINIIDLKYFFYERDSQDEIYLNLILEYMPQSLYQRLRHFVHQRTPMSRLEIKYYMFQLFKSLNYLHHFANVCHRDIKPQNLLVDPETWSLKLCDFGSAKQLKPTEPNVSYICSRYYRAPELIFGATNYTNQIDIWSSGCVMAELLLGQPMFPGESGIDQLVEIIKILGTPSKQEICSMNPNYMEHKFPQIKPIPLSRVFKKEDDQTVEFLADVLKYDPLERFNALQCLCSPYFDELKLDDGKINQITTDLKLLEFDENVELGHLSPDELSSVKKKLYPKSK

SEQ ID NO: 624 - protein, 475 aa, Saccharomyces cerevisiae
  misc_feature (0)...(0): Polypeptide Accession Number YMR153W
MADLQKQENSSRFTNVSVIAPESQGQHEQQKQQEQLEQQKQPTGLLKGLNGFPSAPQPLFMEDPPSTVSGELNDNPAWFNNPRKRAIPNSIIKRSNGQSLSPVRSDSADVPAFSNSNGFNNVTFGSKKDPRILKNVSPNDNNSANNNAHSSDLGTVVFDSNEAPPKTSLADWQKEDGIFSSKTDNIEDPNLSSNITFDGKPTATPSPFRPLEKTSRILNFFDKNTKTTPNTASSEASAGSKEGASTNWDDHAIIIFGYPETIANSIILHFANFGEILEDFRVIKDFKKLNSKNMSKSPSLTAQKYPIYTGDGWVKLTYKSELSKSRALQENGIIMNGTLIGCVSYSPAALKQLASLKKSEEIINNKTSSQTSLSSKDLSNYRKTEGIFEKAKAKAVTSKVRNAEFKVSKNSTSFKNPRRLEIKDGRSLFLRNRGKIHSGVLSSIESDLKKREQASKSKKSWLNRLNNWLFGWNDL

SEQ ID NO: 625 - protein, 150 aa, Saccharomyces cerevisiae
  misc_feature (0)...(0): Polypeptide Accession Number YMR159C
MGNFIITERKKAKEERSNPQTDSMDDLLIRRLTDRNDKEAHLNELFQDNSGAIGGNIVSHDDALLNTLAILQKELKSKEQEIRRLKEVIALKNKNTERLNDELISGTIENNVLQQKLSDLKKEHSQLVARWLKKTEKETEAMNSEIDGTK

SEQ ID NO: 626 - protein, 705 aa, Saccharomyces cerevisiae
  misc_feature (0)...(0): Polypeptide Accession Number YMR163C
MTTNSRPSALQAPGLQIFSMLKSSEEDGFMSSSLTLDSDNIIGVTENNRQEFYSTWRKPSLLSSRSVLHEYSPTIVGSNDCTFSPITVGKTTKFFNWDDIISRIFMQQPFGVTHQFFEEFRYSIITSHFLNDMNHYRLSLHLDQSIMNFHKSSTLLKNVPPKSVPFMATKYGKLAVAEDKKLYFRQNFNYLSMIITSYRVLTQLKKYCRKKNSPGLKRVVILILVAVYLSIQQEYFRRHLICYKTLLKVRKVLESLQQVDVMIHKYHLRFKEIKNHSFISRVSLISIADEHSSVIKELLVFSSDALFYKLKSIIPDIVIFSDTSELSKYCELYGIDVPNLYYNNTTTVKDLDGKLYRLKLLKKFMLCCLLSLDMTGNENLSNVNMRNALNKIFPDYMARVQLKKKYNPIGTFQNIVSLLRGLHSLLSTVLVSLNDHKQILYAFPEETSTNTGCERANVCSFSKNDKLFQALNYLKMIENNLLAIDIRNGITENDRNIIEDKLEELITFWKTSKICGNISRIQKVSPTNTINHGFHLDILKGRKSPRSSSVQGLSLERKVDFIDVAESVNDSFENDTELEEYEDYDCQEECSAGSRQNHRVDFIGKDSCRKPDFKQLSDNELRRKLDERILKLAQENREGRERLRTAKSFELLRKAQASMSVKFGFQKPLRDDAFLESRPLSKCKVSSEETIPFLYELKGLLGNDS

SEQ ID NO: 627 - protein, 862 aa, Saccharomyces cerevisiae
  misc_feature (0)...(0): Polypeptide Accession Number YMR165C
MQYVGRALGSVSKTWSSINPATLSGAIDVIVVEHPDGRLSCSPFHVRFGKFQILKPSQKKVQVFINEKLSNMPMKLSDSGEAYFVFEMGDQVTDVPDELLVSPVMSATSSPPQSPETSILEGGTEGEGEGENENKKKEKKVLEEPDFLDINDTGDSGSKNSETTGSLSPTESSTTTPPDSVEERKLVEQRTKNFQQKLNKKLTEIHIPSKLDNNGDLLLDTEGYKPNKNMMHDTDIQLKQLLKDEFGNDSDISSFIKEDKNGNIKIVNPYEHLTDLSPPGTPPTMATSGSVLGLDAMESGSTLNSLSSSPSGSDTEDETSFSKEQSSKSEKTSKKGTAGSGETEKRYIRTIRLTNDQLKCLNLTYGENDLKFSVDHGKAIVTSKLFVWRWDVPIVISDIDGTITKSDALGHVLAMIGKDWTHLGVAKLFSEISRNGYNILYLTARSAGQADSTRSYLRSIEQNGSKLPNGPVILSPDRTMAALRREVILKKPEVFKIACLNDIRSLYFEDSDNEVDTEEKSTPFFAGFGNRITDALSYRTVGIPSSRIFTINTEGEVHMELLELAGYRSSYIHINELVDHFFPPVSLDSVDLRTNTSMVPGSPPNRTLDNFDSEITSGRKTLFRGNQEEKFTDVNFWRDPLVDIDNLSDISNDDSDNIDEDTDVSQQSNISRNRANSVKTAKVTKAPQRNVSGSTNNNEVLAASSDVENASDLVSSHSSSGSTPNKSTMSKGDIGKQIYLELGSPLASPKLRYLDDMDDEDSNYNRTKSRRASSAAATSIDKEFKKLSVSKAGAPTRIVSKINVSNDVHSLGNSDTESRREQSVNETGRNQLPHNSMDDKDLDSRVSDEFDDDEFDEDEFED

SEQ ID NO: 628 - protein, 320 aa, Saccharomyces cerevisiae
  misc_feature (0)...(0): Polypeptide Accession Number YMR180C
MSDQPETPSNSRNSHENVGAKKADANVASKFRSLHISETTKPLTSTRALYKTTRNNSRGATEFHKHVCKLAWKYLACIDKSSISHIEIEMKFGVITDKRTHRRMTPHNKPFIVQNRNGRLVSNVPEQMFSSFQELLRSKSENPSKCAPRVVKQVQKYTKDSIYNCNNASKVGKLTSWRCSEDLRNKELKLTYIKKVRVKDFLIRYPQSSLDAKISISLEVPEYETSAAFRNGFILQRTKSRSTYTFNDKMPLHLDLTKVTTTRRNSHQYTSHEVEVEMDPIFKETISANDREKFNEYMCSFLNASDLIRKAAERDNMLTT

SEQ ID NO: 629 - protein, 154 aa, Saccharomyces cerevisiae
  misc_feature (0)...(0): Polypeptide Accession Number YMR181C
MTPLLQAEAKMNTSLYLTESIQQHEFNLTSPQSFYSSPSVPNSKNNSGIFSYNTANNSRVSSSDEFTTQQDGMNTIMYKNNISKTFEDDIFYCPRSLLTPEEQVVYQEIDKYYMEQALLTQLQISQTYSSTPKEEKIVKFNPYTSKSFSPASSE

SEQ ID NO: 630 - protein, 371 aa, Saccharomyces cerevisiae
  misc_feature (0)...(0): Polypeptide Accession Number YMR201C
MTPEQKAKLEANRKLAIERLRKRGILSSDQLNRIESRNEPLKTRPLAVTSGSNRDDNAAAAVHVPNHNGQPSALANTNTNTTSLYGSGVVDGSKRDASVLDKRPTDRIRPSIRKQDYIEYDFATMQNLNGGYINPKDKLPNSDFTDDQEFESEFGSKKQKTLQDWKKEQLERKMLYENAPPPEHISKAPKCIECHINIEMDPVLHDVFKLQVCKQCSKEHPEKYALLTKTECKEDYFLTDPELNDEDLFHRLEKPNPHSGTFARMQLFVRCEVEAFAFKKWGGEEGLDEEWQRREEGKAHRREKKYEKKIKEMRLKTRAQEYTNRLREKKHGKAHIHHFSDPVDGGIDEDGYQIQRRRCTDCGLETEEIDI

SEQ ID NO: 631 - protein, 449 aa, Saccharomyces cerevisiae
  misc_feature (0)...(0): Polypeptide Accession Number YMR210W
MRLKELLPNFLIVHQEVPEDPIAFKSTDKRENENKEITIPELIDTKVPELADGATDTLYGLLVNGHLQTAYGSFRHFDNIYKVQYKRMIIKYPHGGEGTVDFAVNGRSTKRRKVEKEYVPTSQPVFNGNLKRRYSYYSPDDPKLNSDDAKPMLIILHGLTGGSRESYVRAIVHEITTKYDFEACVFNARGCCYSAITTPLLYNGGWTNDIRYCVNDLRKRFPNRKFYMMGFSLGASIMTNYLGEESDRTKIECAISVSNPFDLYNSAYFINSTPMGSRFYSPALGHNLLRMVRNHLSTLEENPDFKDVIEKHLKKIRTVRQFDNLLTGPMFGYKNAEEYYKNASSYKRIPGIRTPFIALHAQDDPIVGGDLPIDQIKSNPYTLLLETSTGGHVGWFKDRSGRRWYAEPLCRFLKIFHDEITVKGLKPDLENVQLPDPNCEPIATTFRAN

SEQ ID NO: 632 - protein, 692 aa, Saccharomyces cerevisiae
  misc_feature (0)...(0): Polypeptide Accession Number YMR224C
MDYPDPDTIRILITTDNHVGYNENDPITGDDSWKTFHEVMMLAKNNNVDMVVQSGDLFHVNKPSKKSLYQVLKTLRLCCMGDKPCELELLSDPSQVFHYDEFTNVNYEDPNFNISIPVFGISGNHDDASGDSLLCPMDILHATGLINHFGKVIESDKIKVVPLLFQKGSTKLALYGLAAVRDERLFRTFKDGGVTFEVPTMREGEWFNLMCVHQNHTGHTNTAFLPEQFLPDFLDMVIWGHEHECIPNLVHNPIKNFDVLQPGSSVATSLCEAEAQPKYVFILDIKYGEAPKMTPIPLETIRTFKMKSISLQDVPHLRPHDKDATSKYLIEQVEEMIRDANEETKQKLADDGEGDMVAELPKPLIRLRVDYSAPSNTQSPIDYQVENPRRFSNRFVGRVANGNNVVQFYKKRSPVTRSKKSGINGTSISDRDVEKLFSESGGELEVQTLVNDLLNKMQLSLLPEVGLNEAVKKFVDKDEKTALKEFISHEISNEVGILSTNEEFLRTDDAEEMKALIKQVKRANSVRPTPPKENDETNFAFNGNGLDSFRSSNREVRTGSPDITQSHVDNESRITHISQAESSKPTSKPKRVRTATKKKIPAFSDSTVISDAENELGDNNDAQDDVDIDENDIIMVSTDEEDASYGLLNGRKTKTKTRPAASTKTASRRGKGRASRTPKTDILGSLLAKKRK

SEQ ID NO: 633 - protein, 267 aa, Saccharomyces cerevisiae
  misc_feature (0)...(0): Polypeptide Accession Number YMR226C
MSQGRKAAERLAKKTVLITGASAGIGKATALEYLEASNGDMKLILAARRLEKLEELKKTIDQEFPNAKVHVAQLDITQAEKIKPFIENLPQEFKDIDILVNNAGKALGSDRVGQIATEDIQDVFDTNVTALINITQAVLPIFQAKNSGDIVNLGSIAGRDAYPTGSIYCASKFAVGAFTDSLRKELINTKIRVILIAPGLVETEFSLVRYRGNEEQAKNVYKDTTPLMADDVADLIVYATSRKQNTVIADTLIFPTNQASPHHIFRG

SEQ ID NO: 634 - protein, 341 aa, Saccharomyces cerevisiae
  misc_feature (0)...(0): Polypeptide Accession Number YMR228W
MSVPIPGIKDISKLKFFYGFKYLWNPTVYNKIFDKLDLTKTYKHPEELKVLDLYPGVGIQSAIFYNKYCPRQYSLLEKRSSLYKFLNAKFEGSPLQILKRDPYDWSTYSNLIDEERIFVPEVQSSDHINDKFLTVANVTGEGSEGLIMQWLSCIGNKNWLYRFGKVKMLLWMPSTTARKLLARPGMHSRSKCSVVREAFTDTKLIAISDANELKGFDSQCIEEWDPILFSAAEIWPTKGKPIALVEMDPIDFDFDVDNWDYVTRHLMILKRTPLNTVMDSLGHGGQQYFNSRITDKDLLKKCPIDLTNDEFIYLTKLFMEWPFKPDILMDFVDMYQTEHSG

SEQ ID NO: 635 - protein, 226 aa, Saccharomyces cerevisiae
  misc_feature (0)...(0): Polypeptide Accession Number YMR233W
MADINKYIPMVDAILSVSNPDEISPKRVRKALQILYSVNLDSQRKLINELILERFGDIQENPRVLIPKNDLISRDQELSLRLQKEEERPLRSTRKRKGKSESKSKRKKKKNDSPDSNSISVRKVLLSAPLQKFLGSEELPRTQVVKMIWQYIKEHDLQNPKDRREILCDEKMEPIFGKKMTMFSMNKLLTKHLFNPDEIVKHEEEQKQTPEKEIKLENESLPNLSG

SEQ ID NO: 636 - protein, 157 aa, Saccharomyces cerevisiae
  misc_feature (0)...(0): Polypeptide Accession Number YMR236W
MNGGGKNVLNKNSVGSVSEVGPDSTQEETPRDVRLLHLLLASQSIHQYEDQVPLQLMDFAHRYTQGVLKDALVYNDYAGSGNSAGSGLGVEDIRLAIAARTQYQFKPTAPKELMLQLAAERNKKALPQVMGTWGVRLPPEKYCLTAKEWDLEDPKSM

SEQ ID NO: 637 - protein, 442 aa, Saccharomyces cerevisiae
  misc_feature (0)...(0): Polypeptide Accession Number YMR243C
MITGKELRIISLLTLDTVFFLLEITIGYMSHSLALIADSFHMLNDIISLLVALWAVDVAKNRGPDAKYTYGWKRAEILGALINAVFLIALCFSIMIEALQRLIEPQEIQNPRLVLYVGVAGLISNVVGLFLFHDHGSDSLHSHSHGSVESGNNDLDIESNATHSHSHASLPNDNLAIDEDAISSPGPSGQIGEVLPQSVVNRLSNESQPLLNHDDHDHSHESKKPGHRSLNMHGVFLHVLGDALGNIGVIAAALFIWKTEYSWRYYSDPIVSLIITIIIFSSALPLSRRASRILLQATPSTISADQIQREILAVPGVIAVHDFHVWNLTESIYIASIHVQIDCAPDKFMSSAKLIRKIFHQHGIHSATVQPEFVSGDVNEDIRRRFSIIAGGSPSSSQEAFDSHGNTEHGRKKRSPTAYGATTASSNCIVDDAVNCNTSNCL

SEQ ID NO: 638 - protein, 188 aa, Saccharomyces cerevisiae
  misc_feature (0)...(0): Polypeptide Accession Number YMR255W
MPLESIWADAPDEEPIKKQKPSHKRSNNNKKNNNSRWSNESSSNNKKKDSVNKVKNNKGNHESKTKNKIKETLPREKKPPHSQGKISPVSESLAINPFSQKATEISPPPVSPSKMKTTKTQSKQDTASKMKLLKKKIEEQREILQKTHHKNQQQQVLMDFLNDEGSSNWVDDDEEELILQRLKTSLKI

SEQ ID NO: 639 - protein, 310 aa, Saccharomyces cerevisiae
  misc_feature (0)...(0): Polypeptide Accession Number YMR267W
MNLLRMNALTSKARSIERLKQTLNILSIRNHRQFSTIQQGSKYTLGFKKYLTLLNGEVGSFFHDVPLDLNEHEKTVNMIVEVPRWTTGKFEISKELRFNPIVQDTKNGKLRFVNNIFPYHGYIHNYGAIPQTWEDPTIEHKLGKCDVALKGDNDPLDCCEIGSDVLEMGSIKKVKVLGSLALIDDGELDWKVIVIDVNDPLSSKIDDLEKIEEYFPGILDTTREWFRKYKVPAGKPLNSFAFHEQYQNSNKTIQTIKKCHNSWKNLISGSLQEKYDNLPNTERAGNGVTLEDSVKPPSQIPPEVQKWYYV

SEQ ID NO: 640 - protein, 142 aa, Saccharomyces cerevisiae
  misc_feature (0)...(0): Polypeptide Accession Number YMR269W
MAVLNLLQNEAVATAVSKSSSPLYRWFVKGEGLKGTITNLGKKEEASFVVSSASSSKGKKRRRRDEDDNKVKRKKLKKDKKTSNDSESKKKKKKKSKKESKKGKKSKHSSDEGDKSKHKKSKKSKKHKKEESSARRDRKEHI

SEQ ID NO: 641 - protein, 365 aa, Saccharomyces cerevisiae
  misc_feature (0)...(0): Polypeptide Accession Number YMR270C
MSDLDEESQIETQIDAPIEDIIRGSELTTTTADKETLKSANELLDSLEHSHRVDLSLHLYSAYLLKRLLYKANEKKHFYEVNQFVKTQIKDNWTSWPNPNTIIDPSVDKLYEDIPEGIANVSVQPGEISNRALMHASDMMRVELDAQWQKFLSKSALDHDVTLDVDELNIPNEISRNILVKLDSLFEGLHDKIAKENEFDVRQDKHSNNIRANQIDDEPMQANRRIKYTYHDLVSRGCEMNEDMTDIYMKSLELYNDIPEKYKKRKFRLPKQILKKYHQPKKTSSYLKELLSKTREDFIPVEKLLKDKRLTSKDKSKLQRLNREETEDALNKRTFFQVKGYLEDENEISDYELDDCLIELPNGNI

SEQ ID NO: 642 - protein, 197 aa, Saccharomyces cerevisiae
  misc_feature (0)...(0): Polypeptide Accession Number YMR295C
MMHFRKKSSISNTSDHDGANRASDVKISEDDKARLKMRTASVADPILDAVQEAQPFEQAADTFHDNMNRQSYFSNEEGHVLCDVFGQPITQADISNPTRARDERPLDTIRSFEYAVSGDPVWAQQLETPTYGFRVRPDFPVFGAAVTYDANGMPQQVGGASSQMYGEQAVYQPQQHVQTEEKQKKKKKGLFGRMKKK

SEQ ID NO: 643 - protein, 812 aa, Saccharomyces cerevisiae
  misc_feature (0)...(0): Polypeptide Accession Number YMR309C
MSRFFSSNYEYDVASSSSEEDLLSSSEEDLLSSSSSESELDQESDDSFFNESESESEADVDSDDSDAKPYGPDWFKKSEFRKQGGGSNKFLKSSNYDSSDEESDEEDGKKVVKSAKEKLLDEMQDVYNKISQAENSDDWLTISNEFDLISRLLVRAQQQNWGTPNIFIKVVAQVEDAVNNTQQADLKNKAVARAYNTTKQRVKKVSRENEDSMAKFRNDPESFDKEPTADLDISANGFTISSSQGNDQAVQEDFFTRLQTIIDSRGKKTVNQQSLISTLEELLTVAEKPYEFIMAYLTLIPSRFDASANLSYQPIDQWKSSFNDISKLLSILDQTIDTYQVNEFADPIDFIEDEPKEDSDGVKRILGSIFSFVERLDDEFMKSLLNIDPHSSDYLIRLRDEQSIYNLILRTQLYFEATLKDEHDLERALTRPFVKRLDHIYYKSENLIKIMETAAWNIIPAQFKSKFTSKDQLDSADYVDNLIDGLSTILSKQNNIAVQKRAILYNIYYTALNKDFQTAKDMLLTSQVQTNINQFDSSLQILFNRVVVQLGLSAFKLCLIEECHQILNDLLSSSHLREILGQQSLHRISLNSSNNASADERARQCLPYHQHINLDLIDVVFLTCSLLIEIPRMTAFYSGIKVKRIPYSPKSIRRSLEHYDKLSFQGPPETLRDYVLFAAKSMQKGNWRDSVKYLREIKSWALLPNMETVLNSLTERVQVESLKTYFFSFKRFYSSFSVAKLAELFDLPENKVVEVLQSVIAELEIPAKLNDEKTIFVVEKGDEITKLEEAMVKLNKEYKIAKERLNPPSNRR

SEQ ID NO: 644 - protein, 273 aa, Saccharomyces cerevisiae
  misc_feature (0)...(0): Polypeptide Accession Number YMR312W
MGSVQRQDLVLFSDQSVLPAHFFQDSNSHNLFFITHQSCTQPLWMINALVETHVLGSPSSLNESSSSMLPSSTRSHAVLASFIHEQNYFTNSLNKLKIPSNNYNVLDFLSDFIVNNIHNKPRDKILSDVLAKFSAAIQNNPTDTIVIIEQPELLLSLVSGLTCSELNNKFITPLLRQCKVLIIVSNSDIFNIDEYDASVHSSNLQNFYKSSFIKSMINLNLNPLKTGFAKDVTGSLHVCRGGAPIATSNTSLHVVENEYLYLNEKESTKLFYR

SEQ ID NO: 645 - protein, 234 aa, Saccharomyces cerevisiae
  misc_feature (0)...(0): Polypeptide Accession Number YMR314W
MFRNNYDGDTVTFSPTGRLFQVEYALEAIKQGSVTVGLRSNTHAVLVALKRNADELSSYQKKIIKCDEHMGLSLAGLAPDARVLSNYLRQQCNYSSLVFNRKLAVERAGHLLCDKAQKNTQSYGGRPYGVGLLIIGYDKSGAHLLEFQPSGNVTELYGTAIGARSQGAKTYLERTLDTFIKIDGNPDELIKAGVEAISQSLRDESLTVDNLSIAIVGKDTPFTIYDGEAVAKYI

SEQ ID NO: 646 - protein, 102 aa, Saccharomyces cerevisiae
  misc_feature (0)...(0): Polypeptide Accession Number YMR316C-B
METNDSDDRIEAIVSEESDELEVNSGTTEETNVLELLTIISGLVVTLVLVVLVVLVVVGVVVLVVLLVVVVLLCDVVVAVVDFEPDEPILIRRYPFLWIPFL

SEQ ID NO: 647 - protein, 1140 aa, Saccharomyces cerevisiae
  misc_feature (0)...(0): Polypeptide Accession Number YMR317W
MGSSGSKSTTATTTSHSSTTTTSSTTSTTTPTTTSTTSTTSTKVTTSPEIIVSSSSTLVSSVVPEFTSSSSLSSDTIASILSSESLVSIFSSLSYTSSDISSTSVNDVESSTSGPSNSYSALSSTNAQLSSSTTETDSISSSAIQTSSPQTSSSNGGGSSSEPLGKSSVLETTASSSDTTAVTSSTFTTLTDVSSSPKISSSGSAVTSVGTTSDASKEVFSSSTSDVSSLLSSTSSPASSTISETLPFSSTILSITSSPVSSEAPSATSSSVSSEASSSTSSSVSSEAPLATSSVVSSEAPSSTSSVVSSEAPSSTSSSVSSEISSTTSSSVSSEAPLATSSVVSSEAPSSTSSSVSSEISSTTSSSVSSEAPLATSSVVSSEAPSSTSSSVSSEAPSSTSSSVSSEAPSSTSSSVSSEISSTKSSVMSSEVSSATSSLVSSEAPSAISSLASSRLFSSKNTSVTSTLVATEASSVTSSLRPSSETLASNSIIESSLSTGYNSTVSTTTSAASSTLGSKVSSSNSRMATSKTSSTSSDLSKSSVIFGNSSTVTTSPSASISLTASPLPSVWSDITSSEASSISSNLASSSAPSDNNSTIASASLIVTKTKNSVVSSIVSSITSSETTNESNLATSSTSLLSNKATARSLSTSNATSASNVPTGTFSSMSSHTSVITPGFSTSSASLAINSTVVSSSLAGYSFSTPESSPTTSTLVTSEAPSTVSSMTTSAPFINNSTSARPSPSTASFITESTSSISSVPLASGDVTSSLAAHNLTTFSAPSTSSAQLVSKSTTSSSILVTPRIDRSGNSSTASRIATSLPNKTTFVSSLSSTSAHARNIFNSTVLATAKQIETLTSTVNCSNPTPNYNITKTVIVSRETTAIGTVTSCSGGCTKNRKSTTLITITDIDASTVTTCPEKEVTSTTSGDEAEHTTSTKISNFETSTFSESFKDMKTSQETKKAKPGSETVRSSSSFVEKTSPTTKASPSTSPSESKAAGNTSVATNASPSTSPSESQGTGSTSVEGAKSKSTKNSEGVSTTKAKNTSTVAKSSTESPIGRGETTLETIIVSSQKSLLTSQLSSSTEKVNRSTTKPTAAIHGTSSSAKQSTTYTVSTAKENTGASLNINMKAFVIGAIALVA

SEQ ID NO: 648 - protein, 237 aa, Saccharomyces cerevisiae
  misc_feature (0)...(0): Polypeptide Accession Number YMR322C
MTPKRALISLTSYHGPFYKDGAKTGVFVVEILRSFDTFEKHGFEVDFVSETGGFGWDEHYLPKSFIGGEDKMNFETKNSAFNKALARIKTANEVNASDYKIFFASAGHGALFDYPKAKNLQDIASKIYANGGVIAAICHGPLLFDGLIDIKTTRPLIEGKAITGFPLEGEIALGVDDILRSRKLTTVERVANKNRAKYLAPIHPWDDYSITDGKLVTGVNANSSYSTTIRAINALYS

SEQ ID NO: 649 - protein, 706 aa, Saccharomyces cerevisiae
  misc_feature (0)...(0): Polypeptide Accession Number YNL021W
MDSVMVKKEVLENPDHDLKRKLEENKEEENSLSTTSKSKRQVIVPVCMPKIHYSPLKTGLCYDVRMRYHAKIFTSYFEYIDPHPEDPRRIYRIYKILAENGLINDPTLSGVDDLGDLMLKIPVRAATSEEILEVHTKEHLEFIESTEKMSREELLKETEKGDSVYFNNDSYASARLPCGGAIEACKAVVEGRVKNSLAVVRPPGHHAEPQAAGGFCLFSNVAVAAKNILKNYPESVRRIMILDWDIHHGNGTQKSFYQDDQVLYVSLHRFEMGKYYPGTIQGQYDQTGEGKGEGFNCNITWPVGGVGDAEYMWAFEQVVMPMGREFKPDLVIISSGFDAADGDTIGQCHVTPSCYGHMTHMLKSLARGNLCVVLEGGYNLDAIARSALSVAKVLIGEPPDELPDPLSDPKPEVIEMIDKVIRLQSKYWNCFRRRHANSGCNFNEPINDSIISKNFPLQKAIRQQQQHYLSDEFNFVTLPLVSMDLPDNTVLCTPNISESNTIIIVVHDTSDIWAKRNVISGTIDLSSSVIIDNSLDFIKWGLDRKYGIIDVNIPLTLFEPDNYSGMITSQEVLIYLWDNYIKYFPSVAKIAFIGIGDSYSGIVHLLGHRDTRAVTKTVINFLGDKQLKPLVPLVDETLSEWYFKNSLIFSNNSHQCWKENESRKPRKKFGRVLRCDTDGLNNIIEERFEEATDFILDSFEEWSDEE

SEQ ID NO: 650 - protein, 965 aa, Saccharomyces cerevisiae
  misc_feature (0)...(0): Polypeptide Accession Number YNL023C
MTEHESLGLEQNQDGGDTYRHHNLSDGCISSVEDANEQPSSYEEESDDDMQYYERAIQEISSGDSYVCMICTVEMDYTCQMFACKRCYRVFDYGCIREWALKSTEKTVDRIWKCPNCYYVSKRVPVKNRPTCWCGKVVNPDPNPLDPNSCGQTCNASTCMHGCSKICHLGPHPECTRMVEIMCHCGKHSKSIFCYQSKVMKKNFNCQEVCGLPLSCSIHTCKKKCHPGLCGPCPEMIISKDSPKKQIKCYCGNHTRANIKCSETKFPKSGKSSKDENGNRWIGVFACADNRVVDYSCRKHSFIESCISPPTINGEKACPFLPSSLKTCPCGRTALEELTKPRKHCDDPIPTCDSRCGKPLKCGKHSCPFTCHDKACMEPCLQIDSVKCACEQSTFSVPCGFQGRPRCNIKCESLMSCRRHRCTDRCCSGRPSAIRRKKNLFRTQDLLDESLVEAKHICLKPCNLTLSCGIHKCQRKCHPGKCPPCLESDSNDLVCPCGNTVVPAPVRCGTKLPTCNHPCIKVVRGESTCGHKPMPHTCHSLDVSCPPCTETVFKPCKCGKKTKVRTVCFQTDVSCGIKCGIPLSYCYHTCQKTCHLPGNCQKVCKQTCGQKRLNCNHECPKPCHGKTECPDLPCATLVKIYCKCGRIKKSVTCGAKSDRVSVTESSVLDCNEECEALKRLKELKEAFGIKEETNNFTSNELDALKKLVSVATTFEELQLPFTEAALSVYSKQERWCSQIEAILNKLMDDKTRSSLHFKPMRPPQRHFIRELAKAYGLYSESQDREPMRSVFIKKEDNGASNKPVLSLAEAYPLYESFKQLQKERKAQEFQARTTAKLINFEVQDTEPKVEVAKKNGFLVQNLVAGNTAEDLRRFFEPHLKHTLVVNPQYLILDDGKTALVYPENYETASVNTERDMELLVGHFDFMAKEAFLADSISLCSTEEELERRLDTPVIQEDSPVMDNNT

SEQ ID NO: 651 - protein, 323 aa, Saccharomyces cerevisiae
  misc_feature (0)...(0): Polypeptide Accession Number YNL025C
MSGSFWTSTQRHHWQYTKASLAKERQKLWLLECQLFPQGLNIVMDSKQNGIEQSITKNIPITHRDLHYDKDYNLRIYCYFLIMKLGRRLNIRQYALATAHIYLSRFLIKASVREINLYMLVTTCVYLACKVEECPQYIRTLVSEARTLWPEFIPPDPTKVTEFEFYLLEELESYLIVHHPYQSLKQIVQVLKQPPFQITLSSDDLQNCWSLINDSYINDVHLLYPPHIIAVACLFITISIHGKPTKGSSLASAASEAIRDPKNSSSPVQIAFNRFMAESLVDLEEVMDTIQEQITLYDHWDKYHEQWIKFLLHTLYLRPASAI

SEQ ID NO: 652 - protein, 281 aa, Saccharomyces cerevisiae [sequence omitted]

SEQ ID NO: 653 - protein, 396 aa, Saccharomyces cerevisiae
  misc_feature (0)...(0): Polypeptide Accession Number YNL042W
MSTFNSYSQPKESNDNSHNNVNKSKSLLDIIFGTNVSEWAFSENALMKAMDLKIEQEKTKQQYYKLENLNRSIELFKLASSSGLPINQIHKLFNTDHGVPASSPMKAGGNQPHNNTEGTQSSENLPRLNGSMKSLKPLNMNTVSPTPMSRQPSPYKFPASSSTGGISHSTVTNVQRRANSPARIGASAVAALNDNISIKEEDVARRIPSGTKSQESPLNKKPTSLHSRNLSLPIGKFTNPNIPSTMTSILSFNRDQQQPLSQPLPPPPQQQQDLHTHNLHTIPRKPGMVQKKHRRARSTSSFGVIDLSIIDEAKEKQVQRSPSPIHSNVSVALTSHDKPIESNMKEQPNMLQSVREGRQVHDDLDDRTCSESSSRNESPVRTITKDNSVGKILNST

SEQ ID NO: 654 - protein, 656 aa, Saccharomyces cerevisiae
  misc_feature (0)...(0): Polypeptide Accession Number YNL047C
MSYQRNSARASLDLRSQYQQLEGRMRSEHFNPAYQQQQQKGQNIPLSLPSSLAQRNPIPYPIDAVTSDPTIPAQLNVYDHDRQNSIVDAAAGTNTTHSLNSNNIPSSQNNNINNNNINNVGSFTDPSMLTLPKMSLHSHQKQYDSNQNDPRSPLAILIPTSAQPTDVLSARFSAWRNVIRAILVYLSETASIQDEIVRQQLRLSHAVQFPFFSIENQYQPVSNEDKSMQKFFLPLGSGSVQDLPTMLTKYHDNLASLASKSSKELTSEIIPRLEDLRRDLLVKIKEIKALQSDFKNSCNKELQQTKHLMKLFNESLKECKLGTPKSDPFLIKLQLEKQIKRQLVEENYLHEAFDNLQNSGAQLESVIVMEIQNGLTSYARILGKEAQVVFDSVISKLDSTILNKNTNLEWDSFILRNISNFVPPNLPMRRFKEISYSNQNDPFTFEVKSGFLEKRSKFLKSYSRGFYVLTPSFLHEFKTPDKHKFSTPLMSIPLVECTVTEHSKKTKSNSEQGKNKFILRTNSNGLIHRGHNWVFKVDSYDDMIEWFGNIKALSSLPNYDDKCKYVSKVAKLSKEKAKSNENTTESVTPQVTNEQHTRYDDVSSSNFPLNSIPKLDNLTITNTTSSIPETNDSQIQNRVPEFYIENVDSPRKSNQL

SEQ ID NO: 655 - protein, 197 aa, Saccharomyces cerevisiae
  misc_feature (0)...(0): Polypeptide Accession Number YNL056W
MKYIPPLNFSPVVSTDVSLYRSGYPMPLNYSFIKHQLHLKTIIYIGDKDRPLEEYQSFLESEKIKYYHIFMDSSRDEGIQERMNQVLHLVLDVRNYPILVHSNKGKHRVGVVVGIIRKLLQGWSTAGICQEYGLFSGGMKDGVDLEFITMFETNLKIPRNVIPGFAKHCLYLNELEAAEGSDDESGSESILTAKQPI

SEQ ID NO: 656 - protein, 407 aa, Saccharomyces cerevisiae
  misc_feature (0)...(0): Polypeptide Accession Number YNL078W
METYETSIGTQSYPPTLFPPPLGTGGFTTSGYIHALVDSTSNSNSNSNTNSNTNSNTNSNSDTKIPIVQISDDSHITHDSFKPYMEYHDASHLRNRNISKADQVESTEVMEQFTQWSNYKMRSRSPTINAKPIRHTSQRRTDFTSKNELSKFSKNHNFIFHKGFLKRQHSIRREDRQAKVRSRFRSKKELTSVLNYIELEQMDIANVLASQPVNLHAIRNLTSRDPAVTPIPFLRSQMYATSSRPPYLRNRSISRKLPKSQPGSLPTTMPATATKTIKQNSTTPTTRSVYNKNVGRSNTSPSVLYHPKRRGKLNTKSHARKEQLLLELWREYLMLVITQRTQLRLTLLCSPGSASNESSVCSSNASDLDMSLLSTPSSLFQMAGETKSNPIIIPDSQDDSILSSDPF

SEQ ID NO: 657 - protein, 102 aa, Saccharomyces cerevisiae
  misc_feature (0)...(0): Polypeptide Accession Number YNL086W
MAGDSISADGTGVHPVELSVYSVLSTDLDGLYQSINELRESQALLILMLRKVRDKLRREGQVLYDPEPFKPTMDKLADLSARVRILSQRYEELQGNARALNN

SEQ ID NO: 658 - protein, 1240 aa, Saccharomyces cerevisiae
  misc_feature (0)...(0): Polypeptide Accession Number YNL091W
MPPNSKSKRRKNKSKQHNKKNGNSDPEQSINPTQLVPRMEPELYHTESDYPTSRVIKRAPNGDVIVEPINTDDDKKERTANLTHNKDSMDSASSLAFTLDSHWESLSPEEKKTILRIEKEEVFNVIRNYQDDHSCSCSVCGRRHLAMDQEMERIYNTLYAMDKDKDPETNPIKFHLGIIKELQISKNQQQNDLSSTKGEVVKNFLSSSTVGSLKEEVLHFKQKQLSKQEQAHNETADNTSLLEENLNNIHINKTSSEISANFNSVSDEELQQKYSNFTKTFISSHPKIAEEYVQKMMMYPNIRALTDDLMNSNGQGFLNAIEDFVRDGQIQASKKDDSITEDEASSTDLTDPKEFTTMLHSGKPLTEDEYADLQRNIAERMTNAYDTASKKFKDVSQLEKELFTRFMSGRDKKSFRELIIQSFKNKFDGELGPSVLAATLSSCFSSQSKDTSLDTDSIYEDEDEEDYDDYSEYAEDSEEVSEYEGIEAVEKPEHDEKSNGIRETLHLSYDHDHKRQNHPHHHYHSTSTHSEDELSEEEYISDIELPHDPHKHFHRDDDILDGDEDEPEEEDENEGDDEEDTYDSGLDETDRLEEGRKLIQIAITKLLQSRIMASYHEKQADNNRLKLLQELEEEKRKKREKEEKKQKKREKEKEKKRLQQLAKEEEKRKREEEKERLKKELEEREMRRREAQRKKVEEAKRKKDEERKRRLEEQQRREEMQEKQRKQKEELKRKREEEKKRIREQKRLEQEKLQKEKEEEERQRLIAEDALRKQKLNEEQTSANILSAKPFTENGVGNPVSSQSHPNMTNYQEDNSCSINDEILKMVNSVAASKPVSPTGFNVHDLLLPSTNNQMPAMEQSHLPQPGNQNNHFGTTTIPNALDLATKSSLQTENNYLMNSQTLENTSLLMHNNSSPTKLLPNDFGLSSWGGLTNTMSINPTCKPPVIQTSEMESQAHKSSPQATMPSFGLPNGGTHRKSFTDELNTLTSMLSSSGFADTSLSSSGFPPSQRSVWNDQKSSFSGPSTAGNFNNSSIQSGMLLAPTLGSVESFPNRTSIWDSSTTPMMNKSELSGRNITSTAQDSPAFMASNIWSSNSQYNSPYLTSNVLQSPQISSGVDESHILDSIYNTYLAISPQDSLNPYIAIGTLFQNLVGLNLDYSTFINKLISMQGAYNCEFFTDNNGSITHVRFARQTPAGHSKGLLNQLFSGLNDPTATPFTSRPHTSTRASFPIASSTTQTS

SEQ ID NO: 659 - protein, 220 aa, Saccharomyces cerevisiae
  misc_feature (0)...(0): Polypeptide Accession Number YNL093W
MDKHTAAIPTLTIKVVLLGESAVGKSSIVLRFVSDDFKESKEPTIGAAFLTKRITRDGKVIKFEIWDTAGQERFAPLAPMYYRNAQAALVVFDVTNEGSFYKAQNWVEELHEKVGHDIVIALVGNKMDLLNNDDENENRAMKAPAVQNLCERENLLYFEASAKTGENIYQIFQTLGEKVPCPEQNTRQSSTHDRTITDNQRIDLESTTVESTRETGGCNC

SEQ ID NO: 660 - protein, 587 aa, Saccharomyces cerevisiae
  misc_feature (0)...(0): Polypeptide Accession Number YNL094W
MNSQGYDESSSSTAATSGPTSGDPRMGKKQRFMNLIRTTKDVYIPNLTSSISQKTMDGIRSTTNSFEGYNDLPMELPHNTTITYFPTYTTTNLVDPDGLSAPRKDFETTVRCAVSYPGNPTSRRNRWLLSLCKQYLRTGTAEADVAPVVPPHLEEDSGDLNDSQSSIESSLSSKSENRYSHMGIQEEDVLNERIQGFLSKKVPNTPVVVDLLPKDKLRGDTASFFGTTDSYGNLLIKAETDFLPSKINITLDTPIEGHADPISETFPANYVSPYGIGLISDIDDTIKHTGVTGDRRSMFRNVFIHDVQSWVIDGVPLWYKTLHDVADVDFFYVSNSPIQTFTLLKQYICANFPPGPIFLKQYSGNFFSTIMTSSANRKIQPIANILKDFPKKKFILVGDSGEHDLEAYTTTALQFPNQILAIYIRCCSNSMSDVPSHDEEVMNEVNNIIELQQRPMQMTKSTVRTRRRPPPPPIPSTQKPSLTEEQTESIRMSRRNKDENNAKRVAPPPLPNRQLPNLDANTYYVPSSQNDYGMYGAFMDKKADEWKRRVMDSIQKLSNQDTTLMFFSDPALSLEDSIRRIREKYSN

SEQ ID NO: 661 - protein, 238 aa, Saccharomyces cerevisiae
  misc_feature (0)...(0): Polypeptide Accession Number YNL099C
MTSKVGEYEDVPEDESRLTEENVSVPEEEVEDEDEEEDDDDDHIYINEETESGREKVLVSHAPQERIVPPLNFCPVERYLYRSGQPSPVNFPFLLNLKLKTIIWLSNEEPQDTLLEFCDTHRINLQFAAINPDAGEDDNPWDGLTEHSIINVLQTIVTQENYPLLVCCGMGRHRTGTVIGCLRRIMGWNLASVSEEYRRFTGSRGGRILVELLIEAFDTNLVKIDKNKAPSWLLTALE

SEQ ID NO: 662 - protein, 619 aa, Saccharomyces cerevisiae
  misc_feature (0)...(0): Polypeptide Accession Number YNL104C
MVKESIIALAEHAASRASRVIPPVKLAYKNMLKDPSSKYKPFNAPKLSNRKWPDNRITRAPRWLSTDLRDGNQSLPDPMSVEQKKEYFHKLVNIGFKEIEVSFPSASQTDFDFTRYAVENAPDDVSIQCLVQSREHLIKRTVEALTGAKKATIHTYLATSDMFREIVFNMSREEAISKAVEATKLVRKLTKDDPSQQATRWSYEFSPECFSDTPGEFAVEICEAVKKAWEPTEENPIIFNLPATVEVASPNVYADQIEYFATHITEREKVCISTHCHNDRGCGVAATELGMLAGADRVEGCLFGNGERTGNVDLVTVAMNMYTQGVSPNLDFSDLTSVLDVVERCNKIPVSQRAPYGGDLVVCAFSGSHQDAIKKGFNLQNKKRAQGETQWRIPYLPLDPKDIGRDYEAVIRVNSQSGKGGAAWVILRSLGLDLPRNMQIEFSSAVQDHADSLGRELKSDEISKLFKEAYNYNDEQYQAISLVNYNVEKFGTERRVFTGQVKVGDQIVDIEGTGNGPISSLVDALSNLLNVRFAVANYTEHSLGSGSSTQAASYIHLSYRRNADNEKAYKWGVGVSEDVGDSSVRAIFATINNIIHSGDVSIPSLAEVEGKNAAASGSA

SEQ ID NO: 663 - protein, 142 aa, Saccharomyces cerevisiae
  misc_feature (0)...(0): Polypeptide Accession Number YNL113W
MTEDIEQKKTATEVTPQEPKHIQEEEEQDVDMTGDEEQEEEPDREKIKLLTQATSEDGTSASFQIVEEDHTLGNALRYVIMKNPDVEFCGYSIPHPSENLLNIRIQTYGETTAVDALQKGLKDLMDLCDVVESKFTEKIKSM

SEQ ID NO: 664 - protein, 970 aa, Saccharomyces cerevisiae
  misc_feature (0)...(0): Polypeptide Accession Number YNL118C
MSLPLRHALENVTSVDRILEDLLVRFIINCPNEDLSSVERELFHFEEASWFYTDFIKLMNPTLPSLKIKSFAQLIIKLCPLVWKWDIRVDEALQQFSKYKKSIPVRGAAIFNENLSKILLVQGTESDSWSFPRGKISKDENDIDCCIREVKEEIGFDLTDYIDDNQFIERNIQGKNYKIFLISGVSEVFNFKPQVRNEIDKIEWFDFKKISKTMYKSNIKYYLINSMMRPLSMWLRHQRQIKNEDQLKSYAEEQLKLLLGITKEEQIDPGRELLNMLHTAVQANSNNNAVSNGQVPSSQELQHLKEQSGEHNQQKDQQSSFSSQQQPSIFPSLSEPFANNKNVIPPTMPMANVFMSNPQLFATMNGQPFAPFPFMLPLTNNSNSANPIPTPVPPNFNAPPNPMAFGVPNMHNLSGPAVSQPFSLPPAPLPRDSGYSSSSPGQLLDILNSKKPDSNVQSSKKPKLKILQRGTDLNSIKQNNNDETAHSNSQALLDLLKKPTSSQKIHASKPDTSFLPNDSVSGIQDAEYEDFESSSDEEVETARDERNSLNVDIGVNVMPSEKDSRRSQKEKPRNDASKTNLNASAESNSVEWGPGKSSPSTQSKQNSSVGMQNKYRQEIHIGDSDAYEVFESSSDEEDGKKLEELEQTQDNSKLISQDILKENNFQDGEVPHRDMPTESNKSINETVGLSSTTNTVKKVPKVKILKRGETFASLANDKKAFDSSSNVSSSKDLLQMLRNPISSTVSSNQQSPKSQHLSGDEEIMMMLKRNSVSKPQNSEENASTSSINDANASELLGMLKQKEKDITAPKQPYNVDSYSQKNSAKGLLNILKKNDSTGYPRTEGGPSSEMSTSMKRNDATNNQELDKNSTELLNYLKPKPLNDGYENISNKDSSHELLNILHGNKNSSAFNNNVYATDGYSLASDNNENSSNKLLNMLQNRSSAINEPNFDVRSNGTSGSNELLSILHRK

SEQ ID NO: 665 - protein, 115 aa, Saccharomyces cerevisiae
  misc_feature (0)...(0): Polypeptide Accession Number YNL122C
MKISLHNKRQRGDQNQNMSVFNVLKPLLKGSNSFKVKLNGFLFNNVSTITIRTLMKTHKGTAKRWRRTGNTFKRGIAGRKHGNIGWSHRSLKALTGRKIAHPAYSKHLKRLLPYH

SEQ ID NO: 666 - protein, 953 aa, Saccharomyces cerevisiae
  misc_feature (0)...(0): Polypeptide Accession Number YNL127W
MNASGRSHSKGPIIRSVSLEDLKRNSSFKGNLKYKDEVTSHKEPQVGTLSNEELLKDLDNMLRGKLNMGRNSFHADKRNKSDGNISALTFKARSGLEGDIRTIDIQQDSSDENDNFKFSDDGVNKDRNNEKDNNTDNAVEFQDDAEEAEEENEDESFANVDELDGFDLNKVSDGKHVPINEKGEVDYNMPVDKEFQKSLDQCAASLEERSSAPYALQRAVDWELKMFYSLEDELSEWFCSSDYMHFGQTQTLFKQKITQPQLFFDDENYAASVVECLIEDIPNSLASNLLALSYISMGCFAFTNSKSEHTKIIRRNNLMLVPHIQEIVHAFKKIAISCRDDNRNLKKQTILLFHSSTILYFICSICIEGRGENPEAVNVVIDAFEKTDLLEFLTKYIENWRWNSRLAMRIRNMISLLFKLIVLQFGDSSVYKQTKSSIYNLHGLTYPSKHPEKLSISPLHYQAFREDITSRFPDYNMPSSGLPKDVDKSESLSQFLEIPRPKSKNPLNMALIVPEKHIATPAPSPPSSPQLMHLGEGPRPRKSFQTNMAYPCLYPSDNEGSEDDTLEDRIDLNIERKPDNDIVIPFSTEEAARILSESLEIKLSTKQLWYERDLFMITERGWKQQLENEPYDYAALNHDANSSKEEKSAICIMQRIDKYYKSCLSSFNSLVFVLLQTMESSLTNNFHRKSEVSDKNLLNMLTPQLEIVRAKELSLKSAAGILHALLKWFKLSHILKFEHLAVVIHDSRYINTCASILSKYSEVYPERVFNKYVQTPNSFWKECSLSNESYRESYSVDDSGEVDTEIMPSFAYLLRILRKVTGNKTQRLKELPLSIGILFKRYYRLFNLDMYHPILKITRELTPFKNKRWKSEHMELISGVYLYEKLELTDNWVTGKDISGELSDACGQEIALRALLQFYNFQHYEISMEDLGYGHRNSSSQDLLNKESEYLNI

SEQ ID NO: 667 - protein, 114 aa, Saccharomyces cerevisiae
  misc_feature (0)...(0): Polypeptide Accession Number YNL135C
MSEVIEGNVKIDRISPGDGATFPKTGDLVTIHYTGTLENGQKFDSSVDRGSPFQCNIGVGQVIKGWDVGIPKLSVGEKARLTIPGPYAYGPRGFPGLIPPNSTLVFDVELLKVN

SEQ ID NO: 668 - protein, 546 aa, Saccharomyces cerevisiae
  misc_feature (0)...(0): Polypeptide Accession Number YNL154C
MSQVQSPLTATNSGLAVNNNTMNSQMPNRSNVRLVNGTLPPSLHVSSNLNHNTGNSSASYSGSQSRDDSTIVGLHYKIGKKIGEGSFGVLFEGTNMINGLPVAIKFEPRKTEAPQLKDEYRTYKILAGTPGIPQEYYFGQEGLHNILVIDLLGPSLEDLFDWCGRRFSVKTVVQVAVQMITLIEDLHAHDLIYRDIKPDNFLIGRPGQPDANKVHLIDFGMAKQYRDPKTKQHIPYREKKSLSGTARYMSINTHLGREQSRRDDMEAMGHVFFYFLRGQLPWQGLKAPNNKQKYEKIGEKKRLTNVYDLAQGLPIQFGRYLEIVRNLSFEETPDYEGYRMLLLSVLDDLGETADGQYDWMKLNGGRGWDLSINKKPNLHGYGHPNPPNEKSKRHRSKNHQYSSPDHHHHYNQQQQQQQAQAQAQAQAQAKVQQQQLQQAQAQQQANRYQLQPDDSHYDEEREASKLDPTSYEAYQQQTQQKYAQQQQKQMQQKSKQFANTGANGQTNKYPYNAQPTANDEQNAKNAAQDRNSNKSSKGFFSKLGCC

SEQ ID NO: 669 - protein, 274 aa, Saccharomyces cerevisiae
  misc_feature (0)...(0): Polypeptide Accession Number YNL155W
MSAAIEKETGMLDVGKHCAYCRQLDFLPFHCSFCNEDFCSNHRLKEDHHCRWLLEHEEVHKTEKSPSKSRDGSSSNDEAYFKSLLPERASVRIQRVSETREPLRGSNTAKVSSTLNSKTLDKIFKFFQRNEKRKSNNKSKKNFGSSSNKIIQLANLKKIAKGDPKIPMQNRIYIWCYLVDGDETDIAKEDTRMPLYINKMWPVGRAMDYLSIQLNVKSSTLTNSSSNDKFQLCKLKEGKQVSFYNIGASLRVTNEIKDLDTLYLVHNNADEKSN

SEQ ID NO: 670 - protein, 351 aa, Saccharomyces cerevisiae
  misc_feature (0)...(0): Polypeptide Accession Number YNL164C
MTPTNQSSGTTNASVEVLSEDGPMPINVMMQEGVKALTKILSNQLQDRQAFQNAPHAMQFVIRNGGKALSNARLEELKDALPKMDSLSLEDELAKIDGQSAYHIDSAEEKETFESKIGQIASRNSADFIIEEDLQNILDDDLKDSELNLDGEEAEIIFDYESQELDTPDGIGEKISQMIESVLPGGFGSEEQGGLRTVTNVEDLDVAEEVTDIDHDTVDAARLHGDGQHSISSRKHSRSKNSKKNGHVRRHDFYDESRDHKSCCPHHHYENLSKLRNYYYHDFEYISRTENRVPDFSVLVNESSPMCLFCEYYMVFGEPPRNMIKWYNRTFGYNRMPNPPRDEQDSRKRNR

SEQ ID NO: 671 - protein, 122 aa, Saccharomyces cerevisiae
  misc_feature (0)...(0): Polypeptide Accession Number YNL171C
MSCTPFINQVIHKDYTLPQFWNLLKLVLDTQINILEFCIIHHVVQSFCTTIRVGNPKYLHCFYLNTANLNYKILNPLMLYYFLHSKEYRVPPLSNLEYPNFQPVAKRWYFLVHFLGLILNNF

SEQ ID NO: 672 - protein, 542 aa, Saccharomyces cerevisiae
  misc_feature (0)...(0): Polypeptide Accession Number YNL189W
MDNGTDSSTSKFVPEYRRTNFKNKGRFSADELRRRRDTQQVELRKAKRDEALAKRRNFIPPTDGADSDEEDESSVSADQQFYSQLQQELPQMTQQLNSDDMQEQLSATVKFRQILSREHRPPIDVVIQAGVVPRLVEFMRENQPEMLQLEAAWALTNIASGTSAQTKVVVDADAVPLFIQLLYTGSVEVKEQAIWALGNVAGDSTDYRDYVLQCNAMEPILGLFNSNKPSLIRTATWTLSNLCRGKKPQPDWSVVSQALPTLAKLIYSMDTETLVDACWAISYLSDGPQEAIQAVIDVRIPKRLVELLSHESTLVQTPALRAVGNIVTGNDLQTQVVINAGVLPALRLLLSSPKENIKKEACWTISNITAGNTEQIQAVIDANLIPPLVKLLEVAEYKTKKEACWAISNASSGGLQRPDIIRYLVSQGCIKPLCDLLEIADNRIIEVTLDALENILKMGEADKEARGLNINENADFIEKAGGMEKIFNCQQNENDKIYEKAYKIIETYFGEEEDAVDETMAPQNAGNTFGFGSNVNQQFNFN

SEQ ID NO: 673 - protein, 534 aa, Saccharomyces cerevisiae
  misc_feature (0)...(0): Polypeptide Accession Number YNL199C
MHHQTKLDVFIIRAYNLLSNESVISGASLQSVTNSPQTTTNTPSGMVNGAVGTGIANPTGLMGSDSTPNIDEIITSTGSNALTKTNSDSANGTPNGNSSSTSAISNASNPATTGNNASSSATSNGIYTQAQYSQLFAKISKLYNATLSSGSIDDRSTSPKSAIELYQRFQQMIKELELSFDASPYAKYFRRLDGRLWQIKTDSELENDELWRLVSMSIFTVFDPQTGQILTQGRRKGNSLNTSTKGSPSDLQGINNGNNNGNNGNIGNGSNIKNYGNKNMPNNRTKKRGTRVAKNAKNGKNNKNSNKERNGITDTSAFSNTTISNPGTNMLFDPSLSQQLQKRLQTLSQDVNSRSLTGYYTQPTSPGSGGFEFGLSHADLNPNASSNTMGYNTMSNNGSHSWKRRSLGSLDVNTLDDEAVEELLQLTNTSKRQRPMTTAAEGALINDGPDTNLNANNTQMKVDLNPSNSMGPIDTEAVIRPLKEAYDAIISEKGQRIVQLERELELQRQETQWLRKMLIEDMGCVRSMLRDLQR

SEQ ID NO: 674 - protein, 858 aa, Saccharomyces cerevisiae
  misc_feature (0)...(0): Polypeptide Accession Number YNL201C
MSLPGTPTTSPTPMDEDTEQAVSVNTEPKRVKVYILENNEWKDTGTGFCIGEVDEGKFAYLVVSDEDSPTETLLKSKLEGNIEYQRQEETLIVWKDLGGKDIALSFEESMGCDTLCEFIVHVQRNIESNISLVTVKSSDNGLGSVHDIITGPVTLPSNDQQQNSQTLLEALKILNENTSFDFLKNETIEFILQSNYIDTLISHFHKAEEEKIPKDLFLLSNIIKTLILYNKRDILESMVEDDRIMGIVGILEYDTEYPTSKANHRKYLGSKGPNFKEVIPLENEDLKIIMKKCFRLQFLKDVVLVRFLDDHNFNLISEIVMDLETCIIDFLQVGTFLDRLIELYDTKTLPESSSEKEKFVQKRKDGIRLLQQCVQMSINLDAVDRSKFYKTLVRKGLFKVLDYAFHMETDSNVRILATDTIITIIEHDILLIHNVQNEDSFKRQHKSAPDDKSSHRKYPQDYSSSTDSKLLLILSTILLSDRSPGLREQVVQALNTLLHPEGCVGNGEGSYDLMGRSNYEAKNTSEDFPSFSYGLNSDSINLNNYHYSSDEMNNLEPESESEFQVMEYFANFYNKIAPILFGPLIKKDITTEMAEIDGQIEKVTKDDLLLIHLVKLVSFVCTEHDRVLSRRFILENGILDSVSKLIGGNHMMQLRLTAVRCIKNLMCLDDKYYHRYMISKNLYAPVFKLFQENIDKNNLANSCIQDFFRIIITECRAYQSDGHNRKEKTNGSYDGNGNDVKTNVNNNRTNFTILNKYLVQTYGDVLRKATDIPFIQDMLETGEENQPDHSSFENSIEGGNDISVNMSTDGFASNHLEDIDIKNVKRLHSEIEHFENDPHYSGDQLAFKKSVDQMNAST

SEQ ID NO: 675 - protein, 270 aa, Saccharomyces cerevisiae
  misc_feature (0)...(0): Polypeptide Accession Number YNL210W
MSNQHSPQPFCLDTKLVKLLEELQEGKQFNNKNIFPEKALYLKLALDYSFFRKNLLEFCVHLDKIKGVIRPNYDTIYILCLLEVDLLNLVFTDNILEICLPRFVSREDLRVFNNTFYTYHDNRLRILQEDFSQLFKKIKTKASVLCFTVEEIFLTNQEILPQNSTVAELQKSTNKVQTNGPQRHDFIVTLEIKLNKTQITFLIGAKGTRIESLREKSGASIKIIPISDKMTAHERNHPESVQQTILISGDLYSIALAVTSIESALITLDL

SEQ ID NO: 676 - protein, 587 aa, Saccharomyces cerevisiae [sequence omitted]

SEQ ID NO: 677 - protein, 354 aa, Saccharomyces cerevisiae
  misc_feature (0)...(0): Polypeptide Accession Number YNL229C
MMNNNGNQVSNLSNALRQVNIGNRNSNTTTDQSNINFEFSTGVNNNNNNNSSSNNNNVQNNNSGRNGSQNNDNENNIKNTLEQHRQQQQAFSDMSHVEYSRITKFFQEQPLEGYTLFSHRSAPNGFKVAIVLSELGFHYNTIFLDFNLGEHRAPEFVSVNPNARVPALIDHGMDNLSIWESGAILLHLVNKYYKETGNPLLWSDDLADQSQINAWLFFQTSGHAPMIGQALHFRYFHSQKIASAVERYTDEVRRVYGVVEMALAERREALVMELDTENAAAYSAGTTPMSQSRFFDYPVWLVGDKLTIADLAFVPWNNVVDRIGINIKIEFPEVYKWTKHMMRRPAVIKALRGE

SEQ ID NO: 678 - protein, 892 aa, Saccharomyces cerevisiae
  misc_feature (0)...(0): Polypeptide Accession Number YNL233W
MSDSISDSKSSELLNSTFYSSTSINTLDHARTFRNSLILKEISDQSLNSSIKPCESVLDRDVESSVLQRSFGESNARDSEVQTVNMTTSPSLSALADILNERSKYADQKTRKAQNIESSIIEEEEEAEEQNNSINYHEDITGSRLSVREEANENLAMTSPNLIDIDGSNSIQVAPLSLPSFEEPDFLSTPRVKPDSQGPRSKVSTRRTILERDNNLPVKREENTIINSETESTTHSAPFLKEDPKPSPPSSKLYNPKVRLNKAEARKYTDSSAQRTTSAGSVLEDTSMHKKKKSIFSFLKKKEPKPVIGNNSVTNEKNKMSSSSTFSMNIQTSLKTPEKLKKKSHSSSSIFNSFLKGKIETSDSPRKEPMRQKKRTPKSKDKKQDTEQIIDAASVLSTESPLLRKNHDDTPVKIDHVTRSIDQRKPTPLNMDLILGGDKQINTPLQEHVREDDDAKNDLQLPTKDNFLSLDYEAPSPAFSKHDTGEVLFPKFLDNHEVDSIVSLERTRSTKSNKRSSMNSQRRSLTDTLSIKAQSEGMFITEASSVVLSTPDLTKSPASSILKNGRFEYSDNFSREHSYEGTTNEDFLDIKDDSGPLKKDDIFLESIEQKFDQLVMASDEEKTEVERDVPKPREEPLKKDSERQSVFADDDNELISDIMEFASFINFGDDDLNLDLDLGDTTASYATETPEPVGNDEVNRSGTFDTRNNKEDSYKERETQSYSAAGATTYGDERQGQLHTFEQDGSEINDNEFENEDFNKHIEQPIEVTPRNNAYLPEFEPNRPVSMSFKGLKAPRMNTSFIDSMTPDSPVKSDLTSLGEVYVNSNNDQGVRFSSQIILYDTYGEFEYDRHPEISTCNQLTPQLAQMIKLELNELKSAMEVHDDSRCYTHFY

SEQ ID NO: 679 - protein, 974 aa, Saccharomyces cerevisiae
  misc_feature (0)...(0): Polypeptide Accession Number YNL236W
MMLGEHLMSWSKTGIIAYSDSQSSNANICLTFLESINGINWRFHTPQKYVLHPQLHEVQYQESSSTLSTHSTTTSVNGSTTAGVGSTPNFGGNSNKSPPQFFYNISSIHWNNWFSLPGDMLAVCDELGNMTMLITGQRPDRATTYEKLTMVFQDNVYKIYNHVMPLKPVDKLKPMNIERKQTRKEYNTSILEFRWLTSSKSVIVSQFCAFDSSSNTYRSRAQQVPPYGVYHPPFIKYACLAIRKNGQIDFWYQFSNSKDHKKITLQLLDTSNQRFKDLQWLEFARITPMNDDQCMLITTYSKLSKNISFYKLHVNWNLNATKPNVLNDPSLKIQFILSTTLDPTDDEGHVLKLENLHVVSKSSIEKDPSPEILVLYNVCDTSKSLVKRYRLAPTQLSAEYLVILKPDLNIDRNNSTNQIFQSRRYNLRRHSDIVLDKKVTLITSEMFDAFVSFYFEDGTIESYNQNDWKLETERLISQSQLGKFKNIIASPLSAGFNYGKLPLPPSVEWMKVSPSMCGVIVKQYNKKWPQFYAAVQKNYADPEKDSINATALAFGYVKSLHKQISAEDLTIAAKTHILRISFLDRKRAKEFITTLLKSLYSFFNISPDAPKEIMDKIITSRPLQKIMLLQLELGSCFSQENIEEMARVILYLKNVLFAFNGVARNFHFAIEQISNNSNQQQNPKLFQTIFSKQDLIHSLIPVAKWFVKFITYLTQEILILINDPTNKEYTLVHGIFGAKMSRTLILSILNEIKKVTQIVAKFPETSYPILNESSTFLKLVLSESPVDFEKFETFLVDVNNKFIALCEQQPSQEREFSLLVKAEIPPEYAKVGDFLLQYANNAVISHANAAAVYFADTSGLKISNSEFFNPEIFHLLQPLEEGLIIDTDKLPIKNRTSKSFSKLLYDDVTCDKLSVSEISDGKLKRCSRCGSVTRAGNIISSDKTIVPTSIQTKRWPTMYTRLCICSGMLFEMDG

SEQ ID NO: 680 - protein, 108 aa, Saccharomyces cerevisiae
  misc_feature (0)...(0): Polypeptide Accession Number YNL244C
MSIENLKSFDPFADTGDDETATSNYIHIRIQQRNGRKTLTTVQGVPEEYDLKRILKVLKKDFACNGNIVKDPEMGEIIQLQGDQRAKVCEFMISQLGLQKKNIKIHGF

SEQ ID NO: 681 - protein, 661 aa, Saccharomyces cerevisiae
  misc_feature (0)...(0): Polypeptide Accession Number YNL279W
MSGFKCYLQLGDRLSQIWLNKYTLVLLLAMLKLLFFSKSIQHAIEVSETYILSNCYSIDSLYSKMTDNTPHYLGIMGNYLIEKGMEETVKATLETLSLIVYASEGLVNFAIDLYLGTYACLIVSAVDGTVDVATNITEKLISLVNDTVSSVANELDTGLNDISKIINKVIKAASKVENFFTGDDDDSNMTSSIKSVNLTISALHNLYIPSSINDKLEELSAKTPDFAQVKNTTKNLISVPFNEVRKNIKAVNASNIIGDTSVLYVPPVSLDNSTGICSSNQSEILAFYSILGHVLKIATVVCITVLICFAVGAMAPVAWNEIKLWRRLCGMRDHYMLSRQDSYTSFSSENTHELKDPFRDPPIQNGQYDVIASYQQCFQTWNTRIAGWMTNLVTFGKSPENIDPKTKQKIEWVVAYMTSERALCVLGIGLLGILVCICQFVMIALLKHKISHSLTSNDGDGVQNLLKSSTAVDIENQMSLWSVQTNKYINTTETNINQEVFGWINTTTLSVNNTVATMISDIDTTLADVFNGTLLYNPMKTVVGCAIENKLYTIEKAMTWIHDKAQLHIPRINGTQIKQALAKQTDNSTIPTASSTSAATENLLENLVNDMREGLLKILRAYHRITLGELTVALVILAVWLVQLPIALVILRLRLRKATFD

SEQ ID NO: 682 - protein, 935 aa, Saccharomyces cerevisiae
  misc_feature (0)...(0): Polypeptide Accession Number YNL287W
MSAHTYKKFENSTSGDLPDKMTIYQDCMNTFNESPVNSKRCRLLISRLLRLLAQGETFPQNEATALFFSISKLFQHQNDPLRQAVYLAIKELSGISEDVLMATSSIMKDVQNGSDLIKPDAIRSLTYVLDESTAFSAERLLKSAVVSRHPSISSAALCTSYHLLPISEVTIRRFTNETQEAVLDLKQFPNQHGNSEYYPNSTYISQYHALGLLYQLKKTDKMALLKLVRHFSENNSMKNQLAKVELVKIVNDLIYRDPQLFSQFRPLLSDWLSNKFESVQLETAKLITSFATRNSRLVAPELYAAAISALQSLLTVPRVSSRFAALRILNRISMVSPEKIVVCNPELESLINDSNRNISTYAITTLLKTGTSKNISSLISTITNFIHDVSDDFKIIIIDAVRTLSLNFPQEWKSILNFLIDVLKNSEGGFKFKNSIVEALIDIVSFVPQSKELALENLCDFIEDCEFNEILVRILHLLGKEGPSAPNPSLYVRHIYNRVVLENSIIRSAAVVALSKFALTKNDPTLYESIISLLKRIANDKDDEVRDRATIALEFIDSARNKDDVIAQNLIESKYFYDIPSLESKLSSYISSNTDSFATAFDVNQVRKFTEDEMKAINLKRKQEQIFNQKSETTLDTTPEAESVPEKRADANSFAGPNLDDHQEDLLATKYADELLSIEQIKPFGQLVNSSRAISLTEPEAEFVVRGVKHLFKDNVVLQFNITNTLTDIALDNVSVVCTPEISDEAELEELFTLQVDRLLPSEEAACYVAFKKLDEIVMEGFLNNLTFTTKEINPDTNEPFDGDEGFQDEYEIDSIFLNAGDYVKSSFTGNFSATFDELPCEEVAVFNIQEDLSIQEVVDKIILNSSCLPVESTQFAPSDSNSHTLKLFGKSALTGSKVALQIKMIKSSKGLALKVHGKGEDSLLCSDLVNGLMQ

SEQ ID NO: 683 - protein, 373 aa, Saccharomyces cerevisiae
  misc_feature (0)...(0): Polypeptide Accession Number YNL288W
MFSAQKPIYGNGAGVNMGGGGPSTNNPGSMSMPGVPTSMGPGMNQQIPSGGPMLMGNTPNNNNSNENGENNGNNGNNGGNDANATRNNPNMVNNRGAVHALDDPNVYHWICQLTYGPQKEQALLELGRKREQFDDLAVVLWSSFGVMTSLLNEIISVYPMLQPQMLSNNLSNRVCNALVLLQCVASHPETKHLFLQAHIPLFLFPFLNTTSRQRTFEYLRLTSLGVIGALVKNDSQDVITFLLRTDIVPLCLRIMESSSELSKTVAIFILQKILLDDVGLQYICATLERFYAVTNVLKDMVEHLTVSTPPGRLLKHIIRCYLRLSDDLEARRLLKIVLPAKLRDNTFTEVLRDDVGSKRCLAQLLLTLNEETS

SEQ ID NO: 684 - protein, 763 aa, Saccharomyces cerevisiae
  misc_feature (0)...(0): Polypeptide Accession Number YNL311C
MKRLQLFGRSKYFSLVSSAAKEEEEEEEGCADAKSLLHSTSHDIKSRSLRFNDKSSLMCLPTKVLLLILRTLDFNTLVTLCQVNSRFYNLITNEFLFQNVILDSKLSLLKFNALIHSEFHTSNIVTHSGDCSTQSRSQNARFLVRSIEFKNPQSQDSLLKYSKFYNKSGQDSIIAGSYKLDSYDKDVKKLNNIRLNDETPIITSERIKLLDKLESNYFHYTYIELMLDIIDYLPNLTRVILSDVEPNFKIPLWYSVFNDGSRDFFKKIIKGQQSITNEDLRTFQLSKKFVKEYESKYYSLPRLKILEIKANNKRQRTFNRQRHHQKLVLRPSLFCCFGIINELKLENVTIDTESLDTPMEFLPLFLKNEDNELYSLQSPITALTLDSCDVVPGNGILRLFHSYFKMVKHLSLLKINSKFDLLLCSCFPSLSNLTIDCNSKCFTNEQVVGESYYFQQRSLDTEDDFDDCNSMTETLFEAPSDSKIITPPPTSSVVLSLNLNYISRTTGNDVSNNPSPDNNKKPAMLTAAQLQNFQRQRIPEFHSFYHYYRLLWERLPSKNISINVINIPFTNVYPLSPLSFWEHLARTITSVDETDEDVGDENDQETLIGYENNSIRDNIPNANAVPNLSTVMSPESDIHHTYYWNNSVRRCLRDSLIKLKNRTIEYRDLDVEEFLQNVTLENFFNDFQDPENFKDIPNINLWCFLRNLSKFKAVKIRMLRHFSLCTPRTRYDWELLLKPVLRVNVPIEVRDKDGFVLYSYGQK

SEQ ID NO: 685 - protein, 255 aa, Saccharomyces cerevisiae
  misc_feature (0)...(0): Polypeptide Accession Number YNL314W
MDESVDPVELLLRLLIRHKPHLKPYAYRQDSWQRVLDEYNRQTGSRYRQSRTLKTKFRRLKDLFSADRAQFSPSQLKLMGALLDEAPEHPRPRTKFGNESSSSLSSSSFIKSHPGPDPFQQLSSAEHPNNHSSDDEHSGSQPLPLDSITIGIPPTLHTIPMILSKDNDVGKVIKSPKINKGTNRFSETVLPPQMAAEQSWSDSNMELEICLDYLHNELEVIKKRQEDFECKVLNKLNIIEALLSQMRPPSQGDKI

SEQ ID NO: 686 - protein, 298 aa, Saccharomyces cerevisiae
  misc_feature (0)...(0): Polypeptide Accession Number YNL333W
MSEFKVKTGLAQMLKGGVIMDVVTPEQAIIAERAGACAVMALERIPADMRKSGQVCRMSDPRMIKEIMEAVSIPVMAKVRIGHFVEAQILEELQVDYIDESEVLTPADWTHHIEKHNFKVPFVCGAKDLGEALRRINEGAAMIRTKGEAGTGDVSEAVKHITKIKAEIQQYKENLKTESDFAAKATELRVPVDLLKTTLSEGKLPVVNFAAGGVATPADAALLMQLGCEGVFVGSGIFKSSDPEKLACAIVEATTHYDNPAKLLQISSDLGDLMGGISIQSINEAGGKNGARLSEIGW

SEQ ID NO: 687 - protein, 146 aa, Saccharomyces cerevisiae
  misc_feature (0)...(0): Polypeptide Accession Number YNR004W
MIDLYNYSNLEGLLDGLTDLNRIPKEYSAVLEPYFQNIARNAHLKSRALKICRSNFHKWNEEGAKTVNPEIIRRCLNLWYVLKGKEYKKLKDPPPADNIIKDEIDVSYVKNLNVVRLEFDEFGKLISNPLENLILEEVEVNDFIQE

SEQ ID NO: 688 - protein, 134 aa, Saccharomyces cerevisiae
  misc_feature (0)...(0): Polypeptide Accession Number YNR005C
MVFTSSESSSLLSSLKMTCSMVSMNSLEQISLIKGVPPFFTHILVSFQEDNWVFGLSAVLRILFFIQRIESLGFTLLDLNTSEISNAMGRSRSPLGMLSLVACSINASNSLGVLTDILFLVLYSLLIHLSKKKS

SEQ ID NO: 689 - protein, 622 aa, Saccharomyces cerevisiae
  misc_feature (0)...(0): Polypeptide Accession Number YNR006W
MSVSTPSELDALIEQATSESIPNGDLDLPIALEISDVLRSRRVNPKDSMRCIKKRILNTADNPNTQLSSWKLTNICVKNGGTPFIKEICSREFMDTMEHVILREDSNEELSELVKTILYELYVAFKNDSQLNYVAKVYDKLISRGIKFPEKLTLSNSPTAMFDSKTPADWIDSDACMICSKKFSLLNRKHHCRSCGGVFCQEHSSNSIPLPDLGIYEPVRVCDSCFEDYDLKRHDDSKKSKKHRHKRKKDRDYSTPEDEEELIRKAIELSLKESRNSASSEPIVPVVESKNEVKRQEIEEEEDPDLKAAIQESLREAEEAKLRSERQKASRQMQPQQPSPQPQPIHSVDLSDEEKDSIYMFASLVEKMKSRPLNEILEDSKLQNLAQRVFASKARLNYALNDKAQKYNTLIEMNGKISEIMNIYDRLLEQQLQSINLSQQYTLPQVPSDPYNYLTENVQNPAESYQTPPLQQLSSHQYKPQQDVSRQQSVKANSSPTTNIDHLKTIDVTPHAQQKPQSHVELAPSDPPYPKEEAEDEGTQAVQDEESSTQESRERPYPVETENGETSINKRPQGITRYDFPTVPARKFVQPESTVPLPASSSEIPIKEERPPSPQEELLIEL

SEQ ID NO: 690 - protein, 310 aa, Saccharomyces cerevisiae
  misc_feature (0)...(0): Polypeptide Accession Number YNR007C
MIRSTLSSWREYLTPITHKSTFLTTGQITPEEFVQAGDYLCHMFPTWKWNEESSDISYRDFLPKNKQFLIIRKVPCDKRAEQCVEVEGPDVIMKGFAEDGDEDDVLEYIGSETEHVQSTPAGGTKDSSIDDIDELIQDMEIKEEDENDDTEEFNAKGGLAKDMAQERYYDLYIAYSTSYRVPKMYIVGFNSNGSPLSPEQMFEDISADYRTKTATIEKLPFYKNSVLSVSIHPCKHANVMKILLDKVRVVRQRRRKELQEEQELDGVGDWEDLQDDIDDSLRVDQYLIVFLKFITSVTPSIQHDYTMEGW

SEQ ID NO: 691 - protein, 149 aa, Saccharomyces cerevisiae
  misc_feature (0)...(0): Polypeptide Accession Number YNR010W
MNLQNNVLNQIHQILLPTNPTLDKPNAEATKEEFSSAENRDEKDYLTNQQPKNLSTPSTSSNGEFIPHIFYSLHQIRKDPNNLSNQLETLTGSIRHRLKLCKSLISENEDTKDLLSKSPSEWQDIIHQREQELQIKRDVLDDLYRKLQR

SEQ ID NO: 692 - protein, 501 aa, Saccharomyces cerevisiae
  misc_feature (0)...(0): Polypeptide Accession Number YNR012W
MSHRIAPSKERSSSFISILDDETRDTLKANAVMDGEVDVKKTKGKSSRYIPPWTTPYIIGIGGASGSGKTSVAAKIVSSINVPWTVLISLDNFYNPLGPEDRARAFKNEYDFDEPNAINLDLAYKCILNLKEGKRTNIPVYSFVHHNRVPDKNIVIYGASVVVIEGIYALYDRRLLDLMDLKIYVDADLDVCLARRLSRDIVSRGRDLDGCIQQWEKFVKPNAVKFVKPTMKNADAIIPSMSDNATAVNLIINHIKSKLELKSNEHLRELIKLGSSPSQDVLNRNIIHELPPTNQVLSLHTMLLNKNLNCADFVFYFDRLATILLSWALDDIPVAHTNIITPGEHTMENVIACQFDQVTAVNIIRSGDCFMKSLRKTIPNITIGKLLIQSDSQTGEPQLHCEFLPPNIEKFGKVFLMEGQIISGAAMIMAIQVLLDHGIDLEKISVVVYLATEVGIRRILNAFDNKVNIFAGMIISREKLQNHQYKWALTRFFDSKYFGCD

SEQ ID NO: 693 - protein, 139 aa, Saccharomyces cerevisiae
  misc_feature (0)...(0): Polypeptide Accession Number YNR022C
MLHCTQVCLSALTKRTHRVKVQVLKDFPRFQLYKGQVANVKPSLMRNYLHNFNGAKYILSEEHDINTELLKQYQTLEAKLEEDHQQLSKRHETEVQKNMELRKESVFGHKKEEKPKEEKKGLLDSGITIEEVKIPGLDI

SEQ ID NO: 694 - protein, 119 aa, Saccharomyces cerevisiae
  misc_feature (0)...(0): Polypeptide Accession Number YNR025C
MTNTKKILHNALYYVLIIIYEYVLLLVHCLRYFFEFLFLFLPLWLVFFFLMLSLNNLSRSYSSSPSSWLPVNSLSLASLFSSSFCSPSSNFLFLEPLSSELSPKVFLPLITPSGFRSSL

SEQ ID NO: 695 - protein, 429 aa, Saccharomyces cerevisiae
  misc_feature (0)...(0): Polypeptide Accession Number YNR029C
MSALRNIKFNEEEDGELPCLVTGEENNLQEILENVSYDGGNIVSDAKVERVNKQVENTSAGATDVHEKKRIPVSIITGYLGSGKSTLLEKIALKGADKKIAVILNEFGDSSEIEKAMTIKNGSNSYQEWLDLGNGCLCCSLKNIGVKAIEDMVERSPGKIDYILLETSGIADPAPIAKMFWQDEGLNSSVYIDGIITVLDCEHILKCLDDISIDAHWHGDKVGLEGNLTIAHFQLAMADRIIMNKYDTIEHSPEMVKQLKERVREINSIAPMFFTKYSDTPIQNLLDIHAYDSVRISDILDSGSGNGTIHDDRMGTIMLTFRPLKNEEEYNNKFIKQFLQPLLWKNFGAMTVLGGRRRDDGRDWEVQRTKGLILIEGENPIARVIQGVRDTYDVFPGKYDGSNKECKIVLIGKYLEKESIEELLRKTLE

SEQ ID NO: 696 - protein, 393 aa, Saccharomyces cerevisiae
  misc_feature (0)...(0): Polypeptide Accession Number YNR048W
MGLILRWKEKKQLSSKQNAQKSRKPANTSFRQQRLKAWQPILSPQSVLPLLILMACVFAPIGIGLVVSTISVQRLVVNYTECDALAPAKHFETIPSEYVDYHFSKKVAVQPQWMVLTDPELGNQTCRIQFEVPNHIKKSTYVYYRLTNFNQNYREYVQSLDLDQLKGKALIGNDLDPNCDPLRTVENKTIFPCGLIANSMFNDTFGTTLTGVNDTADYLLTTKGIAWDTDSHRYGKTEYNASDIVPPPNWAKLFPNGYTDDNIPDLQNWEQFKIWMRTAALPNFYKLAMKNETNGLGKGIYIADIELNYPVRSFYGTKSFVLTTNSIIGAGNEALGIVYLIVAGIATLFAILFLIKVIFKPRPMHDHSYLNFENSDTPFDESSVVSIPLREIL

SEQ ID NO: 697 - protein, 433 aa, Saccharomyces cerevisiae
  misc_feature (0)...(0): Polypeptide Accession Number YNR052C
MQSMNVQPRVLAVGGEQFFSQRQASEQHQQQNMGPQVYSPKVNRARMFPQGMPVNTINGSVNQEMNNAYLLKQKNEPLLTQQQQQQQQQQQPFNIGTPVSVASLPPGLNVLQQQQQQQQQQQQQQQGVGLNRPLASQLPKHLTNQSMPPIFLPPPNYLFVRDVWKSNLYSEFAVIRQLVSQYNHVSISTEFVGTLARPIGTFRSKVDYHYQTMRANVDFLNPIQLGLSLSDANGNKPDNGPSTWQFNFEFDPKKEIMSTESLELLRKSGINFEKHENLGIDVFEFSQLLMDSGLMMDDSVTWITYHAAYDLGFLINILMNDSMPNNKEDFEWWVHQYMPNFYDLNLVYKIIQEFKNPQLQQSSQQQQQQQYSLTTLADELGLPRFSIFTTTGGQSLLMLLSFCQLSKLSMHKFPNGTDFAKYQGVIYGIDGDQ

SEQ ID NO: 698 - protein, 272 aa, Saccharomyces cerevisiae
  misc_feature (0)...(0): Polypeptide Accession Number YNR068C
MRNRQNQKNWTNLRGLLSVEEREKLENLRLELVCMQAANSIPHDPPEISSLETELICLTTNTKDCKPVRFHSDLLLKKHKYNEIKKIFKEILENIEAYRDEFTKNQTKINLLLADDARASLRNRSLDFSDLMPSSIIKDVQVLANMEANVVVMKNALKTKLVGEKSVPVASSPISSIIPRTSRNKKTSPSNYHHSVLSHRKSNEWNQVSSTEYKRTLLLNIKYNDDFKATIVPSFESCLCSRSYFLRVKLHFDKGVGSAEIDIPVQVKNSFI

SEQ ID NO: 699 - protein, 489 aa, Saccharomyces cerevisiae
  misc_feature (0)...(0): Polypeptide Accession Number YNR069C
MQESKEPQNKFEGCQRISSSSSTLFGGTSFEEPRCGTSQGKEEDAFACNNGDHCSSITNVQEDDFVLPELLPSFEMYENLLSNIPQSSFDTYFPENPPFYEVASRNQSIPSEGESGNDMRILTGDIVGPDNHEVTVDGRRFASGPAESQIRNYDDTKGIPVENIYALPRIKTPIATELYVTKTAPKFGQLPKHESMLREYTSGDIIHGYFTVENKSTKPIKFDMFYLTLEGTTSSKTQSPFGIQKTTERILRMVDMAASWSYNHEDVNTGEDLCGFFDSIDKTSFGLPNSRILNPGDKRKKFFTFKIPNQLLDVTCKHGHFSHSLLPPTLGFDRPSSSHPELSTLKFSESLGYGRLSERGSSLWLNDSSSGSLINYSINAMIVGKDVASGRVCLMSEKKYSIRIVPFGFQNNPISREKCLKDLEDFDIEIANRLGMIEKVFSKIERAIPIHKEDIQEANRSDQLSPLRGKYEWNAVAGNTENGTLKKKH

SEQ ID NO: 700 - protein, 769 aa, Saccharomyces cerevisiae
  misc_feature (0)...(0): Polypeptide Accession Number YOL006C
MTIADASKVNHELSSDDDDDVPLSQTLKKRKVASMNSASLQDEAEPYDSDEAISKISKKKTKKIKTEPVQSSSLPSPPAKKSATSKPKKIKKEDGDVKVKTTKKEEQENEKKKREEEEEEDKKAKEEEEEYKWWEKENEDDTIKWVTLKHNGVIFPPPYQPLPSHIKLYYDGKPVDLPPQAEEVAGFFAALLESDHAKNPVFQKNFFNDFLQVLKESGGPLNGIEIKEFSRCDFTKMFDYFQLQKEQKKQLTSQEKKQIRLEREKFEEDYKFCELDGRREQVGNFKVEPPDLFRGRGAHPKTGKLKRRVNPEDIVLNLSKDAPVPPAPEGHKWGEIRHDNTVQWLAMWRENIFNSFKYVRLAANSSLKGQSDYKKFEKARQLKSYIDAIRRDYTRNLKSKVMLERQKAVAIYLIDVFALRAGGEKSEDEADTVGCCSLRYEHVTLKPPNTVIFDFLGKDSIRFYQEVEVDKQVFKNLTIFKRPPKQPGHQLFDRLDPSILNKYLQNYMPGLTAKVFRTYNASKTMQDQLDLIPNKGSVAEKILKYNAANRTVAILCNHQRTVTKGHAQTVEKANNRIQELEWQKIRCKRAILQLDKDLLKKEPKYFEEIDDLTKEDEATIHKRIIDREIEKYQRKFVRENDKRKFEKEELLPESQLKEWLEKVDEKKQEFEKELKTGEVELKSSWNSVEKIKAQVEKLEQRIQTSSIQLKDKEENSQVSLGTSKINYIDPRLSVVFCKKYDVPIEKIFTKTLREKFKWAIESVDENWRF

SEQ ID NO: 701 - protein, 1093 aa, Saccharomyces cerevisiae
  misc_feature (0)...(0): Polypeptide Accession Number YOL034W
MTSLIDLGRYVERTHHGEDTEPRSKRVKIAKPDLSSFQPGSIIKIRLQDFVTYTLTEFNLSPSLNMIIGPNGSGKSTFVCAVCLGLAGKPEYIGRSKKVEDFIKNGQDVSKIEITLKNSPNVTDIEYIDARDETIKITRIITRSKRRSDYLINDYQVSESVVKTLVAQLNIQLDNLCQFLSQERVEEFARLKSVKLLVETIRSIDASLLDVLDELRELQGNEQSLQKDLDFKKAKIVHLRQESDKLRKSVESLRDFQNKKGEIELHSQLLPYVKVKDHKEKLNIYKEEYERAKANLRAILKDKKPFANTKKTLENQVEELTEKCSLKTDEFLKAKEKINEIFEKLNTIRDEVIKKKNQNEYYRGRTKKLQATIISTKEDFLRSQEILAQTHLPEKSVFEDIDIKRKEIINKEGEIRDLISEIDAKANAINHEMRSIQRQAESKTKSLTTTDKIGILNQDQDLKEVRDAVLMVREHPEMKDKILEPPIMTVSAINAQFAAYLAQCVDYNTSKALTVVDSDSYKLFANPILDKFKVNLRELSSADTTPPVPAETVRDLGFEGYLSDFITGDKRVMKMLCQTSKIHTIPVSRRELTPAQIKKLITPRPNGKILFKRIIHGNRLVDIKQSAYGSKQVFPTDVSIKQTNFYQGSIMSNEQKIRIENEIINLKNEYNDRKSTLDALSNQKSGYRHELSELASKNDDINREAHQLNEIRKKYTMRKSTIETLREKLDQLKREARKDVSQKIKDIDDQIQQLLLKQRHLLSKMASSMKSLKNCQKELISTQILQFEAQNMDVSMNDVIGFFNEREADLKSQYEDKKKFVKEMRDTPEFQSWMREIRSYDQDTKEKLNKVAEKYEEEGNFNLSFVQDVLDKLESEIAMVNHDESAVTILDQVTAELRELEHTVPQQSKDLETIKAKLKEDHAVLEPKLDDIVSKISARFARLFNNVGSAGAVRLEKPKDYAEWKIEIMVKFRDNAPLKKLDSHTQSGGERAVSTVLYMIALQEFTSAPFRVVDEINQGMDSRNERIVHKAMVENACAENTSQYFLITPKLLTGLHYHEKMRIHCVMAGSWIPNPSEDPKMIHFGETSNYSFD

SEQ ID NO: 702 - protein, 761 aa, Saccharomyces cerevisiae
  misc_feature (0)...(0): Polypeptide Accession Number YOL036W
MEHQDSSPPRFRNSGSNRVTVYNGTTLPTMPKSATPTSSSTTVTTHLQNIKEEETNDDELTQVDRSSPRVLGRISSTSSSSSNIDLRDNLDMLHEIEKSNTNISLSAPNLHEELGVLSDKGNSKEELALLPPLPHTGEMEITPQFDINEAIFERDDISHSSRLEPDDVLTKLANSTRDATGEDQGFVVMTHGHDASTNDDSQLSATILDNQTSFDLSKALEMTSHSNISNIINSSGSEGRRSRTPVSNSTLKPNLSSPESAEREANTTSSSSTSDHGATMQYDPKKIITPIPVLPSSVREQQQNNAPLRERSRSNSSALASTLRDTIISGLPQNINSVERKLSRKSNRSRKNTVTFEDRLQKLPPLSTQISNQYAKVAPAENNIALHFHNLPTPVSNTQTPVTFQSESGLTGGEKKMPFLRRASSALLRKTSAKNCSNLTRTNTPTLSTSSTFESDLNARQPMLIRRSSTIDNKLPRRQLSCSKLYSRLNSDSKFANSSRASEEVLVSTPNDTEHVYRKTSLGSKIKRGFTRILSDSNNSKEILTLSPKSMVTTGPTELSFSSLSTVGGHPTTPVSKENDRVSIDGVSTFNRASTSLPESSTDDISPLREEGKINVPKRTSSRKILSKNSSKKNVLPEQQTKPSEIYLDKEALQSFVPVLSVTEGTHRINRSSLQTQSTIGLCITNLRNKEGMKLNAKEYVEILAQQQRKEDERYAVLERKFASCRWCSDKDLQYLKKKRISMNKIWSDYVRFYRGKLNNP

SEQ ID NO: 703 - protein, 420 aa, Saccharomyces cerevisiae
  misc_feature (0)...(0): Polypeptide Accession Number YOL058W
MSKGKVCLAYSGGLDTSVILAWLLDQGYEVVAFMANVGQEEDFDAAKEKALKIGACKFVCVDCREDFVKDILFPAVQVNAVYEDVYLLGTSLARPVIAKAQIDVAKQEGCFAVSHGCTGKGNDQIRFELSFYALKPDVKCITPWRMPEFFERFAGRKDLLDYAAQKGIPVAQTKAKPWSTDENQAHISYEAGILEDPDTTPPKDMWKLIVDPMDAPDQPQDLTIDFERGLPVKLTYTDNKTSKEVSVTKPLDVFLAASNLARANGVGRIDIVEDRYINLKSRGCYEQAPLTVLRKAHVDLEGLTLDKEVRQLRDSFVTPNYSRLIYNGFLLHPECEYIRSMIQPSQNSVNGTVRVRLYKGNVIILGRSTKTEKLYDPTESSMDELTGFLPTDTTGFIAIQAIRIKKYGESKKTKGEELTL

SEQ ID NO: 704 - protein, 440 aa, Saccharomyces cerevisiae
  misc_feature (0)...(0): Polypeptide Accession Number YOL059W
MLAVRRLTRYTFLKRTHPVLYTRRAYKILPSRSTFLRRSLLQTQLHSKMTAHTNIKQHKHCHEDHPIRRSDSAVSIVHLKRAPFKVTVIGSGNWGTTIAKVIAENTELHSHIFEPEVRMWVFDEKIGDENLTDIINTRHQNVKYLPNIDLPHNLVADPDLLHSIKGADILVFNIPHQFLPNIVKQLQGHVAPHVRAISCLKGFELGSKGVQLLSSYVTDELGIQCGALSGANLAPEVAKEHWSETTVAYQLPKDYQGDGKDVDHKILKLLFHRPYFHVNVIDDVAGISIAGALKNVVALACGFVEGMGWGNNASAAIQRLGLGEIIKFGRMFFPESKVETYYQESAGVADLITTCSGGRNVKVATYMAKTGKSALEAEKELLNGQSAQGIITCREVHEWLQTCELTQEFPLFEAVYQIVYNNVRMEDLPEMIEELDIDDE

SEQ ID NO: 705 - protein, 496 aa, Saccharomyces cerevisiae
  misc_feature (0)...(0): Polypeptide Accession Number YOL061W
MSMSNIVVFGGDSHPELVTKICENLDIHPSKVELGKFSNGETNIALRESVREKDVYIIQSGCGQVNDTFMQLLILISACKSASASRVTAVMPYLCYSRQPDIPYTAKGAPIISKPKENYTFESHPGTPVSSSLMTQRPGAESSLKSLDSAIRSTINLENPQPIRTPNSSATANNNFDIKKTLSFSRIPMIPGGKLQNTSNSTDAGELFNAQNAGYKLWVVQAGTLIAHLLSAAGADHVITMDLHDPQFPGFFDIPVDNLYCKPIAQNYIQHRIPDYQDAVIVSPDAGGAKRATAIADALELSFALIHKERRSQLLKGPPDATLTSGGSLPVSPRPLVTTLVSSQNTTSSGATGVAALEMKKTTSTSSTSSQSSNSSKFVQTTMLVGDVRNKVCIIVDDLVDTSYTITRAAKLLKDQGSTKVYALITHGVFSGDALERIGQSSIDKLIISNTVPQDRTLQYLGKDRVDVIDVSCIIGEAIRRIHNGESISMLFEHGW

SEQ ID NO: 706 - protein, 451 aa, Saccharomyces cerevisiae
  misc_feature (0)...(0): Polypeptide Accession Number YOL069W
MSRNQDVFPILDLQELVICLQSCDFALATQENISRPTSDYMVTLYKQIIENFMGISVESLLNSSNQETGDGHLQEENENIYLDTLNVLVLNKICFKFFENIGVQDFNMTDLYKPEAQRTQRLLSAVVNYARFREERMFDCNSFILQMESLLGQLRSKFDDYNLIQQQLKQYEDVDGDNIPDEQELQKLEEQNKELEIQLKKLTKIQETLSIDYNDYKISKQSIFKDLEALSFQIVELESNRDKLIKISNTDMEELSEGIKELNDLLIQRKKTLDDLTAQQKNLQDTVTTFETIISELYDVLRIISSEVQESNRTETELVGLKQNLINNKLKLMNVLETGIMYKLEILQEQLDLQLKNLEKLSQDTKEESRLNDTKLMDLQIKYENEIKPKIDKTDIFIQEELISGKINKLNDEIKQLQKDFEVEVKEIEIEYSLLSGHINKYMNEMLEYMQ

SEQ ID NO: 707 - protein, 501 aa, Saccharomyces cerevisiae
  misc_feature (0)...(0): Polypeptide Accession Number YOL070C
MSEEREENGISRATLNTQRLSAMIDSLNNEKDDRLFPSPTTTRTMITEEKADQSDVFKPPSRLLRSPAGDVSLPPGDNRSSMISNYSGIIQEGVEVSYVVKNRQQTQERRTSKDSNSLYSLKEPVSKNELPSLPMLPSEATLTKHLSDNQSTKSNTNADEIVIKPVTNAKPVGRFNSNTSKKVEGRGSLKLLSSPLRQEKVMRSSIGSGNLASESGSSTYNTKFHQSIQEQLEEEEEGNVSDKLSIVSSVIPELYTTTNEAPKAINPIRSETNDYNPTIPPRSKDRPRSRLFIEEGDGEGDLLTEEILPTPVQPGGHYKNSSQISTVSEQKSESYYSAATSMPPEEETYLTRPLPSTPNEDSRVTSNLKRDDTLKAIHDRANHTSTSTNKQDDDMYEDIIEETPKKTKLKKDTKKKLNKKKSVKELRSFDIDTLNQLLSVTKGTLIGSEFAQLGMKIEEKRALERLVDSLSRLTADMVLDPDRYEEGLKRLDKATKALEGF

SEQ ID NO: 708 - protein, 415 aa, Saccharomyces cerevisiae
  misc_feature (0)...(0): Polypeptide Accession Number YOL082W
MNNSKTNQQMNTSMGYPLTVYDECNKFQLIVPTLDANIMLWCIGQLSLLNDSNGCKHLFWQPNDKSNVRILLNNYDYGHLFKYLQCQRKCSVYIGEGTLKKYNLTISTSFDNFLDLTPSEEKESLCREDAHEDPVSPKAGSEEEISPNSTSNVVVSRECLDNFMKQLLKLEESLNKLELEQKVTNKEPNHRISGTIDIPEDRSELVNFFTELKTVKQLEDVFQRYHDYERLSQECDSKTEIASDHSKKETKIEVEPPNERSLQITMNQRDNSLYFQLFNNTNSVLAGNCKLKFTDAGDKPTTQIIDMGPHEIGIKEYKEYRYFPYALDLEAGSTIEIENQYGEVIFLGKYGSSPMINLRPPSRLSAESLQASQEPFYSFQIDTLPELDDSSIISTSISLSYDGDDNEKALTWEEL

SEQ ID NO: 709 - protein, 412 aa, Saccharomyces cerevisiae
  misc_feature (0)...(0): Polypeptide Accession Number YOL083W
MKIAVETTLFDFFVIDQFKKSTFSAPNTKVDTIKGCINKFIEQFNVYDEQHIFWQPPGKSNVRLLSNANDFGQLGNFLHKKIKCNIFIGEEALRKYDLNICGPYDKFVENSDPSVKKVVNRDDVMLSRKCLNIISEQLSILEKSISKAQNQVLQSSEVEGKKCIILPEDKPELIKFFSKFETSVQLQEVYEGYKVYEKLLQKFGGQKKRMESFLNENTPMSGAEAIKQINISEELKEKGERLTTPNDPLLHVEVSNEDNSLHFILYNKTNIIIPGNCTFEFSSQISEVFSIKMGPHEIGIKGQKELWFFPSLPTPLSNYTMKVVNQDGETILVGKCADSNEITLKSPLASFSTGSFQTGSFHTLQDPTNVFRADALSSPDESSIMSTPFLGETDEVYNSGSTLSRPFTWEEI

SEQ ID NO: 710 - protein, 277 aa, Saccharomyces cerevisiae
  misc_feature (0)...(0): Polypeptide Accession Number YOL088C
MKLHGFLFSVLSTCVVILPALAYSEAVTMVKSIEQYFDICNRNDSYTMIKYYTSWCQHCKTLAPVYEELGELYAKKANKDDTPINFLEVNCEFFGPTLCTDLPGFPIIELVKPRTKPLVLPKLDWSSMKFHERLWQRIKTWFNNPKYQLDTSRVVRFEGSRNLKSLSNFIDTVRSKDTEERFIEHIFDDSRNCNEELRSQQLLCKAGKEYYSDTLSKLYGDVNGLEKERRRLEALIKQNGDDLSKEVKEKLKIIRLQLSLLSHIEDQLEDTSSHDEL

SEQ ID NO: 711 - protein, 609 aa, Saccharomyces cerevisiae
  misc_feature (0)...(0): Polypeptide Accession Number YOL091W
MDNILKASNMEGTSTMTVTSRSSEDSSCISNHEQDTDTHKDGDTSGLENSKISKRKWMKEFFKLSKSPASKSSRSIGSMKSNQSLVSMKSSDDGNSYKNDYSSICGNSLPSAGLSRSNSVKELKLDSTGSQRSKNNVAMLARSSTTSQTTCSSSSSSSSYNSIKGNENDILLQNNNHFRHNKEIPQSKGSSNINTASIMSQYNVDTQATAIMSDMQKQYDSQQMTSPFVNEDLHFDPNGEVSHVIKAIFKEIGYKYDDFSDIPVFQLMQEMYQLVKKNSSARRTKITDYASKLKEKEAQLKSQNDKILKLETTNKAYKTKYKEVSLENKKIKEAFKELDNESYNHDEELLKKYKYTRETLDRVNREQQLIIDQNEFLKKSVNELQNEVNATNFKFSLFKEKYAKLADSITELNTSTKKREALGENLTFECNELKEICLKYKKNIENISNTNKNLQNSFKNERKKVLDLRNERNLLKKEILLIECHGSYSLLLVSNILTCYRFLLPSDTIIETESLIKELLNMNNSLSNHVSSSDEPPAEYSKRLELKCVEFEEKLLYFYQELVTKKIIDVIYKCFINYYKKSRQTDQKSNQNSSTPYKQSQRQVPHSIK

SEQ ID NO: 712 - protein, 556 aa, Saccharomyces cerevisiae
  misc_feature (0)...(0): Polypeptide Accession Number YOL105C
MERVWFAKLTNKGTIKIGYISFILLSLLCQSLIGLVNADFNYEGCYSAADIQSAGLSLKNSYIYQSVSYCQNQCPESAVVALFNGSDCYCGNSVSFLTSLTKSTDSNCGTKCSGWPYQMCGGSSYMNVYVNAETFVSSVESSSSKEGSSTSYMPSTTSSLSSAQISSTTRRTSTDMKSSEMIATTVSTTSTTSSSTSSTTSSTTSSTTSSTTSSTTSSSTSSTTSSTTSSTTSSTTSSTTSSTTSSTTSSTTSSTTSIFSVTSSSSSITLSSSEHTTVDSRTSSPSSTLVPVSSSSSTLSTPKVTSMTPSTSSTIPIVTSVELVTSVVTKAIVSTSDQHQETIFVTRTSVVERSSEVATATAAASNNRSNSTSKQRLSGGAIAGIVIGVVFGVIFIILILLFLIWRRRKSHDQLDLEETKHYQPYSFGDEDANPIGPPPSSGTTNWMRHSRGNTAGSIGTSNMYGFSMSNGANYSSPSSNTSGSIINNLAGLQDATVQKQNLPSTVFEEANTLNSANERFSANSLPDMMMSGPLQVVNPDNPDNPELSSTVSHNRA

SEQ ID NO: 713 - protein, 117 aa, Saccharomyces cerevisiae
  misc_feature (0)...(0): Polypeptide Accession Number YOL106W
MLNVRQYYRTIETHIFPNINNSTEKWVNFEIIVGIPSLIKAIILGIQNVLEVLLDDIGIPIMESIFLCTNITIIPHSISYVSLSYYIIDPCISASSNFGDSFYNNLCHYLTPYMIIY

SEQ ID NO: 714 - protein, 151 aa, Saccharomyces cerevisiae
  misc_feature (0)...(0): Polypeptide Accession Number YOL108C
MTNDIKEIQTIQPGLSEIKEIKGELANVKKRKRRSKKINKLTDGQIRINHVSSEKKRRELERAIFDELVAVVPDLQPQESRSELIIYLKSLSYLSWLYERNEKLRKQIIAKHEAKTGSSSSSDPVQEQNGNIRDLVPKELIWELGDGQSGQ

SEQ ID NO: 715 - protein, 212 aa, Saccharomyces cerevisiae
  misc_feature (0)...(0): Polypeptide Accession Number YOL111C
MSTSASGPEHEFVSKFLTLATLTEPKLPKSYTKPLKDVTNLGVPLPTLKYKYKQNRAKKLKLHQDQQGQDNAAVHLTLKKIQAPKFSIEHDFSPSDTILQIKQHLISEEKASHISEIKLLLKGKVLHDNLFLSDLKVTPANSTITVMIKPNPTISKEPEAEKSTNSPAPAPPQELTVPWDDIEALLKNNFENDQAAVRQVMERLQKGWSLAK

SEQ ID NO: 716 - protein, 534 aa, Saccharomyces cerevisiae
  misc_feature (0)...(0): Polypeptide Accession Number YOL123W
MSSDEEDFNDIYGDDKPTTTEEVKKEEEQNKAGSGTSQLDQLAALQALSSSLNKLNNPNSNNSSSNNSNQDTSSSKQDGTANDKEGSNEDTKNEKKQESATSANANANASSAGPSGLPWEQLQQTMSQFQQPSSQSPPQQQVTQTKEERSKADLSKESCKMFIGGLNWDTTEDNLREYFGKYGTVTDLKIMKDPATGRSRGFGFLSFEKPSSVDEVVKTQHILDGKVIDPKRAIPRDEQDKTGKIFVGGIGPDVRPKEFEEFFSQWGTIIDAQLMLDKDTGQSRGFGFVTYDSADAVDRVCQNKFIDFKDRKIEIKRAEPRHMQQKSSNNGGNNGGNNMNRRGGNFGNQGDFNQMYQNPMMGGYNPMMNPQAMTDYYQKMQEYYQQMQKQTGMDYTQMYQQQMQQMAMMMPGFAMPPNAMTLNQPQQDSNATQGSPAPSDSDNNKSNDVQTIGNTSNTDSGSPPLNLPNGPKGPSQYNDDHNSGYGYNRDRGDRDRNDRDRDYNHRSGGNHRRNGRGGRGGYNRRNNGYHPYNR

SEQ ID NO: 717 - protein, 859 aa, Saccharomyces cerevisiae
  misc_feature (0)...(0): Polypeptide Accession Number YOL130W
MSSSSSSSESSPNLSRSNSLANTMVSMKTEDHTGLYDHRQHPDSLPVRHQPPTLKNKEIAKSTKPSIPKEQKSATRYNSHVDVGSVPSRGRMDFEDEGQGMDETVAHHQLRASAILTSNARPSRLAHSMPHQRQLYVESNIHTPPKDVGVKRDYTMSSSTASSGNKSKLSASSSASPITKVRKSSLVSPVLEIPHESKSDTHSKLAKPKKRTYSTTSAHSSINPAVLLTKSTSQKSDADDDTLERKPVRMNTRASFDSDVSQASRDSQETEEDVCFPMPPQLHTRVNGIDFDELEEYAQFANAEKSQFLASLQVPNEQKYSNVSQDIGFTSSTSTSGSSAALKYTPRVSQTGEKSESTNETEIHEKKEDEHEKIKPSLHPGISFGKNKVEGEENENIPSNDPAYCSYQGTDFQIPNRFSFFCSESDETVHASDIPSLVSEGQTFYELFRGGEPTWWLDCSCPTDDEMRCIAKAFGIHPLTAEDIRMQETREKVELFKSYYFVCFHTFENDKESEDFLEPINVYIVVCRSGVLTFHFGPISHCANVRRRVRQLRDYVNVNSDWLCYALIDDITDSFAPVIQSIEYEADAIEDSVFMARDMDFAAMLQRIGESRRKTMTLMRLLSGKADVIKMFAKRCQDEANGIGPALTSQINIANLQARQDNASHIKNNSSTTVPNNYAPTTSQPRGDIALYLGDIQDHLLTMFQNLLAYEKIFSRSHTNYLAQLQVESFNSNNKVTEMLGKVTMIGTMLVPLNVITGLFGMNVKVPGENSSIAWWFGILGVLLLLAVLGWFLASYWIKRIDPPATLNEAAESGAKSVISSFLPKRNKRFNDRSKNINVRAGPSNKSVASLPSRYSRYD

SEQ ID NO: 718 - protein, 222 aa, Saccharomyces cerevisiae
  misc_feature (0)...(0): Polypeptide Accession Number YOL135C
MSNDPGNEVSSLYPPPPPYVKFFTQSNLEKLPKYKEKKAASAKQTAPNNSNGGSEEEITCALDYLIPPPMPKNQQYRAFGSIWQVKDQLPDLESMGLTQLYKKSTENESTNYQYKIQELRKLLKSLLLNYLELIGVLSINPDMYERKVENIRTILVNIHHLLNEYRPHQSRESLIMLLEEQLEYKRGEIREIEQVCKQVHDKLTSIQDTLRTGSQSPPSSSQ

SEQ ID NO: 719 - protein, 213 aa, Saccharomyces cerevisiae
  misc_feature (0)...(0): Polypeptide Accession Number YOL139C
MSVEEVSKKFEENVSVDDTTATPKTVLSDSAHFDVKHPLNTKWTLWYTKPAVDKSESWSDLLRPVTSFQTVEEFWAIIQNIPEPHELPLKSDYHVFRNDVRPEWEDEANAKGGKWSFQLRGKGADIDELWLRTLLAVIGETIDEDDSQINGVVLSIRKGGNKFALWTKSEDKEPLLRIGGKFKQVLKLTDDGHLEFFPHSSANGRHPQPSITL

SEQ ID NO: 720 - protein, 169 aa, Saccharomyces cerevisiae
  misc_feature (0)...(0): Polypeptide Accession Number YOL143C
MAVKGLGKPDQVYDGSKIRVGIIHARWNRVIIDALVKGAIERMASLGVEENNIIIETVPGSYELPWGTKRFVDRQAKLGKPLDVVIPIGVLIKGSTMHFEYISDSTTHALMNLQEKVDMPVIFGLLTCMTEEQALARAGIDEAHSMHNHGEDWGAAAVEMAVKFGKNAF

SEQ ID NO: 721 - protein, 231 aa, Saccharomyces cerevisiae
  misc_feature (0)...(0): Polypeptide Accession Number YOL149W
MTGAATAAENSATQLEFYRKALNFNVIGRYDPKIKQLLFHTPHASLYKWDFKKDEWNKLEYQGVLAIYLRDVSQNTNLLPVSPQEVDIFDSQNGSNNIQVNNGSDNSNRNSSGNGNSYKSNDSLTYNCGKTLSGKDIYNYGLIILNRINPDNFSMGIVPNSVVNKRKVFNAEEDTLNPLECMGVEVKDELVIIKNLKHEVYGIWIHTVSDRQNIYELIKYLLENEPKDSFA

SEQ ID NO: 722 - protein, 313 aa, Saccharomyces cerevisiae
  misc_feature (0)...(0): Polypeptide Accession Number YOR006C
MGKGKNKMHEPKNGRPQRGANGHSSRQNHRRMEMKYDNSEKMKFPVKLAMWDFDHCDPKRCSGKKLERLGLIKSLRVGQKFQGIVVSPNGKGVVCPDDLEIVEQHGASVVECSWARLEEVPFNKIGGKHERLLPYLVAANQVNYGRPWRLNCVEALAACFAIVGRMDWASELLSHFSWGMGFLELNKELLEIYQQCTDCDSVKRAEEEWLQKLEKETQERKSRAKEEDIWMMGNINRRGNGSQSDTSESEENSEQSDLEGNNQCIEYDSLGNAIRIDNMKSREAQSEESEDEESGSKENGEPLSYDPLGNLIR

SEQ ID NO: 723 - protein, 346 aa, Saccharomyces cerevisiae
  misc_feature (0)...(0): Polypeptide Accession Number YOR007C
MSASKEEIAALIVNYFSSIVEKKEISEDGADSLNVAMDCISEAFGFEREAVSGILGKSEFKGQHLADILNSASRVPESNKKDDAENVEINIPEDDAETKAKAEDLKMQGNKAMANKDYELAINKYTEAIKVLPTNAIYYANRAAAHSSLKEYDQAVKDAESAISIDPSYFRGYSRLGFAKYAQGKPEEALEAYKKVLDIEGDNATEAMKRDYESAKKKVEQSLNLEKTVPEQSRDADVDASQGASAGGLPDLGSLLGGGLGGLMNNPQLMQAAQKMMSNPGAMQNIQKMMQDPSIRQMAEGFASGGGTPNLSDLMNNPALRNMAGNLFGGAGAQSTDETPDNENKQ

SEQ ID NO: 724 - protein, 566 aa, Saccharomyces cerevisiae
  misc_feature (0)...(0): Polypeptide Accession Number YOR023C
MMSPAQDKLQHQHHNPNSSSSSSSKMTNVYQVTTPKSPQDLENNMDEPFKMDTATSNPDKDSENTQRLKYECAKGEIQNVLNLHIMLNHKHVRHLRRNVQKVNAKLALLETLHKDTGLLNKIERTYQLKIKQHQQHSVLGGHFHDSTATENTNASNYNLSYPVLSDYNINCQPLSSSSNRNLSTTRIPHHHYHTRSKSNGLLLEPSALRPANSNIIDYRLTGSKSLSEAITKPTPVSLPHSNSDGISSPRSSSISPLDEQPGFQILPFKPSQMHLNHRRNYSSTCLTSNSGIIGKTENNEPIFRRYDGILVIITCSKCDRSGFTSAQGIVNHTRLKHSKLYSSQPLAVLNNQKLLPNDKQDPEILSKFKKLNLDPNKDYLPSDIAIPKPQSPINHSENHTRAPKTVKNTPHLEKLYQNKEDFKKLIDMVNETPDDLNEYLKQREIQLRYQKEQEEESSKSDDEASYVPSPSLSATATTTTTTDPPSPPVLSSSLQRKLLRKRKLSLNSSTPMEDLPLRERLRANPTDKKPRKAALLTNELEGPDPAAKSSSYYNLRSKSRLRGSHT

SEQ ID NO: 725 - protein, 447 aa, Saccharomyces cerevisiae
  misc_feature (0)...(0): Polypeptide Accession Number YOR025W
MTSVSPSPPASRSGSMCSDLPSSLQTEKLAHIIGLDADDEVLRRVTKQLSRSRRIACLTGAGISCNAGIPDFRSSDGLYDLVKKDCSQYWSIKSGREMFDISLFRDDFKISIFAKFMERLYSNVQLAKPTKTHKFIAHLKDRNKLLRCYTQNIDGLEESIGLTLSNRKLPLTSFSSHWKNLDVVQLHGDLKTLSCTKCFQTFPWSRYWSRCLRRGELPLCPDCEALINKRLNEGKRTLGSNVGILRPNIVLYGENHPSCEIITQGLNLDIIKGNPDFLIIMGTSLKVDGVKQLVKKLSKKIHDRGGLIILVNKTPIGESSWHGIIDYQIHSDCDNWVTFLESQIPDFFKTQDQIKKLRQLKREASDLRKQMKAQKDSIGTPPTTPLRTAQGIDIQGNNELNTKIKSLNTVKRKILSPENSSEEDEEENLDTRKRAKIRPTFGDNQAS

SEQ ID NO: 726 - protein, 341 aa, Saccharomyces cerevisiae
  misc_feature (0)...(0): Polypeptide Accession Number YOR026W
MQIVQIEQAPKDYISDIKIIPSKSLLLITSWDGSLTVYKFDIQAKNVDLLQSLRYKHPLLCCNFIDNTDLQIYVGTVQGEILKVDLIGSPSFQALTNNEANLGICRICKYGDDKLIAASWDGLIEVIDPRNYGDGVIAVKNLNSNNTKVKNKIFTMDTNSSRLIVGMNNSQVQWFRLPLCEDDNGTIEESGLKYQIRDVALLPKEQEGYACSSIDGRVAVEFFDDQGDDYNSSKRFAFRCHRLNLKDTNLAYPVNSIEFSPRHKFLYTAGSDGIISCWNLQTRKKIKNFAKFNEDSVVKIACSDNILCLATSDDTFKTNAAIDQTIELNASSIYIIFDYEN

SEQ ID NO: 727 - protein, 288 aa, Saccharomyces cerevisiae
  misc_feature (0)...(0): Polypeptide Accession Number YOR036W
MSEDEFFGGDNEAVWNGSRFSDSPEFQTLKEEVAAELFEINGQISTLQQFTATLKSFIDRGDVSAKVVERINKRSVAKIEEIGGLIKKVNTSVKKMDAIEEASLDKTQIIAREKLVRDVSYSFQEFQGIQRQFTQVMKQVNERAKESLEASEMANDAALLDEEQRQNSSKSTRIPGSQIVIERDPINNEEFAYQQNLIEQRDQEISNIERGITELNEVFKDLGSVVQQQGVLVDNIEANIYTTSDNTQLASDELRKAMRYQKRTSRWRVYLLIVLLVMLLFIFLIMKL

SEQ ID NO: 728 - protein, 258 aa, Saccharomyces cerevisiae
  misc_feature (0)...(0): Polypeptide Accession Number YOR039W
MGSRSENVGTVTREGSRVEQDDVLMDDDSDSSEYVDMWIDLFLGRKGHEYFCDVDPEYITDRFNLMNLQKTVSKFSYVVQYIVDDLDDSILENMTHARLEQLESDSRKLYGLIHARYIITIKGLQKMYAKYKEADFGRCPRVYCNLQQLLPVGLHDIPGIDCVKLYCPSCEDLYIPKSSRHSSIDGAYFGTSFPGMFLQAFPDMVPKHPTKRYVPKIFGFELHKQAQLTRWQELQRLKLVEKLESKDVDLTKSGGFKT

SEQ ID NO: 729 - protein, 444 aa, Saccharomyces cerevisiae
  misc_feature (0)...(0): Polypeptide Accession Number YOR047C
MFVSPPPATARNQVLGKRKSKRHDENPKNVQPNADTEMTNSVPSIGFNSNLPHNNQEINTPNHYNLSSNSGNVRSNNNFVTTPPEYADRARIEIIKRLLPTAGTKPMEVNSNTAENANIQHINTPDSQSFVSDHSSSYESSIFSQPSTALTDITTGSSLIDTKTPKFVTEVTLEDALPKTFYDMYSPEVLMSDPANILYNGRPKFTKRELLDWDLNDIRSLLIVEQLRPEWGSQLPTVVTSGINLPQFRLQLLPLSSSDEFIIATLVNSDLYIEANLDRNFKLTSAKYTVASARKRHEEMTGSKEPIMRLSKPEWRNIIENYLLNVAVEAQCRYDFKQKRSEYKRWKLLNSNLKRPDMPPPSLIPHGFKIHDCTNSGSLLKKALMKNLQLKNYKNDAKTLGAGTQKNVVNKVSLTSEERAAIWFQCQTQVYQRLGLDWKPDGMS

SEQ ID NO: 730 - protein, 339 aa, Saccharomyces cerevisiae
  misc_feature (0)...(0): Polypeptide Accession Number YOR061W
MPLPPSTLNQKSNRVYSVARVYKNACEERPQEYWDYEQGVTIDWGKISNYEIINKIGRGKYSEVFSGRCIVNNQKCVIKVLKPVKMKKIYRELKILTNLTGGPNVVGLYDIVQDADSKIPALIFEEIKNVDFRTLYPTFKLPDIQYYFTQLLIALDYCHSMGIMHRDVKPQNVMIDPTERKLRLIDWGLAEFYHPGVDYNVRVASRYHKGPELLVNLNQYDYSLDLWSVGCMLAAIVFKKEPFFKGSSNPDQLVKIATVLGTKELLGYLGKYGLHLPSEYDNIMRDFTKKSWTHFITSETKLAVPEVVDLIDNLLRYDHQERLTAKEAMDHKFFKTKFE

SEQ ID NO: 731 - protein, 268 aa, Saccharomyces cerevisiae
  misc_feature (0)...(0): Polypeptide Accession Number YOR062C
MTSLDDSVLTKKNIALLDNATNYIRPAIDYFHFKFNYDSLDVSTTWRLLLKMRKHKLLRLPSCSSENEFDYSIYMARLYHCIWRRWSIKHFNLDEYKIDPLSINWNKEIDVTVLYGPDLVGIHEREQPTPTDFPMGNIKEQGKQLLDVRKEGSASSLLKKGSVFYSKGKWLSQRSISFDDTVRRRDIDKRGRFRESCVLINDVEQFQNYSIVWDESRHRYRRQALPDTYDYEHLYPNGDETPRNTPHDNIIIHQNLHSITEGSYIYIK

SEQ ID NO: 732 - protein, 312 aa, Saccharomyces cerevisiae
  misc_feature (0)...(0): Polypeptide Accession Number YOR069W
MESMLKKICQDPVLQKDKDFLLFLTSDDFSSESKKRAFLTGSGAINDSNDLSEVRISEIQLLGAEDAAEVLKNGGIDAESHKGFMSISFSSLPKYNEADEFFIEKKQKIDELEDNLKKLSKSLEMVDTSRNTLAASTEEFSSMVETLASLNVSEPNSELLNNFADVHKSIKSSLERSSLQETLTMGVMLDDYIRSLASVKAIFNQRSKLGYFLVVIENDMNKKHSQLGKLGQNIHSEKFREMRKEFQTLERRYNLTKKQWQAVGDKIKDEFQGFSTDKIREFRNGMEISLEAAIESQKECIELWETFYQTNL

SEQ ID NO: 733 - protein, 214 aa, Saccharomyces cerevisiae
  misc_feature (0)...(0): Polypeptide Accession Number YOR078W
MSNGHVKFDADESQASASAVTDRQDDVLVISKKDKEVHSSSDEESDDDDAPQEEGLHSGKSEVESQITQREEAIRLEQSQLRSKRRKQNELYAKQKKSVNETEVTDEVIAELPEELLKNIDQKDEGSTQYSSSRHVTFDKLDESDENEEALAKAIKTKKRKTLKNLRKDSVKRGKFRVQLLSTTQDSKTLPPKKESSIIRSKDRWLNRKALNKG

SEQ ID NO: 734 - protein, 232 aa, Saccharomyces cerevisiae
  misc_feature (0)...(0): Polypeptide Accession Number YOR111W
MSGNSQLPPDVIGFICSKYDIILASTSPRRYEILHDIMGITDLKTMVSTFEENLDKMNYSTDPIGYVCDTSWHKAQNIIEILTDYEDENPNEIDKPKLIICADTIIIDKSGRIYEKPKTKEVQKKFLMKFCYEDDEPVNVVTAVTLIKWYGRENFELVPFRDETKVYFDNKIPLRILEEYVESGDGLEVGGGFKIQGQGAILIEKIEGDYYNVVGLPLNKTFKGLYAEANSI

SEQ ID NO: 735 - protein, 268 aa, Saccharomyces cerevisiae
  misc_feature (0)...(0): Polypeptide Accession Number YOR115C
MSSTHSNNVGHPQSSPQGPLTEQQRAQQQYQIFENSLPKVSQSVYQMLLNEMVPLAMGIERQISGDVISSDSNVTSENGNINNMIKRLKIEEHHTVDIIRSHNLIHELYKADEEEKEKVLARLRNIGFQIGLKLSELLIFSNNPNLKFKEMDLLLIMKFICRDVWKQIFGKQIDNLKTNHRGTFYLLDYDYRPIQSFSLEEDAKNEELKMIEPFLEIPVGIIRGVLSSLGYSSEEVICLASFIDRPTDRPKTAFPKGVSFHVQVTMPQ

SEQ ID NO: 736 - protein, 1007 aa, Saccharomyces cerevisiae
  misc_feature (0)...(0): Polypeptide Accession Number YOR127W
MASTAPNEQFPSCVRCKEFITTGHAYELGCDRWHTHCFACYKCEKPLSCESDFLVLGTGALICFDCSDSCKNCGKKIDDLAIILSSSNEAYCSDCFKCCKCGENIADLRYAKTKRGLFCLSCHEKLLAKRKYYEEKKRRLKKNLPSLPTPVIDNGHTDEVSASAVLPEKTFSRPASLVNEIPSGSEPSKDIETNSSDIVPHFITGYNDSDDNSGSSKFGSNVSIDVIGPEENSTEHVNDDVKEEAEAPSANMSLNVATDPTLSCKEPPSHSRNLLNKTPLRNSSGQYLAKSPSSYRQGIIVNDSLEESDQIDPPNNSSRNASELLTSVLHSPVSVNMKNPKGSNTDIFNTGEISQMDPSLSRKVLNNIVEETNALQRPVVEVVKEDRSVPDLAGVQQEQAEKYSYSNNSGKGRKISRSLSRRSKDLMINLKSRATGKQDSNVKLSPASKVTSRRSQDLMRDNDSHTGLDTPNSNSTSLDILVNNQKSLNYKRFTDNGTLRVTSGKETALEEQKNHSFKSPSPIDHLLQSPATPSNVSMYRTPPLDSSLTFDRRNGSSYSNQNYSIPSWQKTPKTQLENSDNFEEQKETLYENSESRNDPSLDKEIVTAEHYLKQLKINLKELESQREELMKEITEMKSMKEALRRHIESYNSEKNKLYLDSNELSNNPPMINEISLGESPPVKHVATASSVARSSVKPKFWKFFSSAKPQTEQSIQGVSTNNTNSIVKSAPVLLSAPSSGSNSGRLEISPPVLQNPNEFSDVRLVPIENDANMGQSKDGEEYLDGSNLYGSSLVARCNYENNEIPMILSVCIDFIESDEENMRSEGIYRKSGSQLVIEEIEKQFSAWKVQQNTETPNILTEQDLNVVTGVLKRYLRKLPNPIFTFQIYEPLMRLVKSKKMMENLPFVGGKLSLEAKNSDTYMSSKSALKNILEDLPREHYRVLRVLSEHIEKVTRYSHWNRMTLYNLALVFAPGLIRDFSGEKDIIDMKERNYIVAFIFGNYKDILT

SEQ ID NO: 737 - protein, 571 aa, Saccharomyces cerevisiae
  misc_feature (0)...(0): Polypeptide Accession Number YOR128C
MDSRTVGILGGGQLGRMIVEAANRLNIKTVILDAENSPAKQISNSNDHVNGSFSNPLDIEKLAEKCDVLTIEIEHVDVPTLKNLQVKHPKLKIYPSPETIRLIQDKYIQKEHLIKNGIAVTQSVPVEQASETSLLNVGRDLGFPFVLKSRTLAYDGRGNFVVKNKEMIPEALEVLKDRPLYAEKWAPFTKELAVMIVRSVNGLVFSYPIVETIHKDNICDLCYAPARVPDSVQLKAKLLAENAIKSFPGCGIFGVEMFYLETGELLINEIAPRPHNSGHYTIDACVTSQFEAHLRSILDLPMPKNFTSFSTITTNAIMLNVLGDKHTKDKELETCERALATPGSSVYLYGKESRPNRKVGHINIIASSMAECEQRLNYITGRTDIPIKISVAQKLDLEAMVKPLVGIIMGSDSDLPVMSAACAVLKDFGVPFEVTIVSAHRTPHRMSAYAISASKRGIKTIIAGAGGAAHLPGMVAAMTPLPVIGVPVKGSCLDGVDSLHSIVQMPRGVPVATVAINNSTNAALLAVRLLGAYDSSYTTKMEQFLLKQEEEVLVKAQKLETVGYEAYLENK

SEQ ID NO: 738 - protein, 551 aa, Saccharomyces cerevisiae
  misc_feature (0)...(0): Polypeptide Accession Number YOR132W
MTSAVPYDPYDDLDNNPFAEPQEEDSEPAATTTDGSSSMSEERVGTEQTAASVQDNGTANNIQNGLGEEGNATRSKTSNEHNENQQPSQPSERVILPERSDEKKKYTLLAKVTGLERFGSATGKKENPTIIFDCSTNLPTFRKQQYKNVKKSYEEFHQLFKYLNVAIQESFVPTLPSAYTTFGINSEEDRMKVTRNFQLWFNRLSQDPLIIRNEEVAFFIESDFNTYTPINKSKSLASGLKRKTLKQLAPPYDEITELAEFRPLVKSIYVVSQSLQEKLLRVSRNRKMMVQEENAFGQDFVNLDEHNKLYRRYGKILTAVGDIDSIIATMDMATLYDGLEWIVRDAYAVKEALTNRHFIMRNLVQAQQNSKAKQEQARRFRSRRDINPMKIDEALRQLKAAAKNEQVLTLKLQRITSNMIIERKQWISWYEEWIRSSIKEFTLRKIEYERKKLTLLERVRSDIRKADENGGLSRLGRHAVSNNNSDTSQTLKGDSWTGESNRKSQIPINKIAHTEFDDELFTEDDGYNSQDSDTTSLNARHAASLLGMSTK

SEQ ID NO: 739 - protein, 671 aa, Saccharomyces cerevisiae
  misc_feature (0)...(0): Polypeptide Accession Number YOR138C
MMDNQAVKSLLEMGIPHEVAVDALQRTGGNLEAAVNFIFSNELPEQAEMGEENDGSQPRISENKIVAGTKPCDVPNNGDQDIDMPDVSGVDVDYDDDEDITDERSGSNSTSGCRVTAQNYDRYSISETSIPPPSYSIVQHNEFKSNVGDPTVVLPLPLNSLIESYFGLFALLTAVYFPHVFLKPDFKDLNYRADWFKGSSFTEPKYRLAYCEAEDGSTTSEIVLASGPNEGLQPHLLWQLQKLISVVNTRKCERAFVSAKVFTSSLEPQLRSKLADSEHLYEVLPAFIKSLAVDLEMCPGIRDRETRSLFISSALHTPNKNEPPMETFLSLFHFLPEEYDSNLYKMFNVLLYPEEEEEEEDVIRGGEQEEARYVEPENTLKEVAPVLTILFNELETNTESVSLPNGVDIPLEFYPQLYTKQCKDQLIRHIISKRKQARTRSRCLLQEINELKSYQGKNISTILESTLAYLQTIPDDANNEAAKQIASLKDTLNSARAAKMEEYKDLASKLHGEWNLSHPETHIINTAKQLGLIENPYILTMAALSPYSYFIRSRNGAWSWIQSNTLGTEFKVKKCSSPSVVQEAIKHGTKYASETPLMFIYCEEGKIPTEEVVAEALKSNSGCLKFAEDDQNSLKTLRSQFFDGMGDPEQATNNINNGNDNDNDDDIDSDN

SEQ ID NO: 740 - protein, 94 aa, Saccharomyces cerevisiae
  misc_feature (0)...(0): Polypeptide Accession Number YOR159C
MSNKVKTKAMVPPINCIFNFLQQQTPVTIWLFEQIGIRIKGKIVGFDEFMNVVIDEAVEIPVNSADGKEDVEKGTPLGKILLKGDNITLITSAD

SEQ ID NO: 741 - protein, 539 aa, Saccharomyces cerevisiae
  misc_feature (0)...(0): Polypeptide Accession Number YOR161C
MPLNEKYERPPQPPPAYDPNHRPPSSSENSAAANVNDGQTPYHFRQDQYYNLNSKTSGAPIGSFDEAFPTENDNKPRWNDWPFTIFFLCTVGGFIAIAAITLRAWSQTYSSTGSGIYDGVNTGTLNTNAAILLVFVCIIALVFSVLGLTLCRIFPKQFIYCGMVINLVASLGTAIMYMSLRYWSAGIVFLVFTFMTAWCYWGMRSRIPLSVAVLKVVVDAMKKCPQIFFVSFVGALVASAFGFLFSAVIVATYIKYDPNSSNGGCDVSGGSCSHSKLIGVLVVVFFCGYYISEVIRNVIHCVISGVFGSWYYMSKSDQGMPRWPAFGALKRAMTYSFGSICFGSLLVALIDLLRQILQMIRHDVTSSGGGQIAIQILFMVFDWIIGFLKWLAEYFNHYAYSFIALYGKPYLRAAKETWYMLREKGMDALINDNLINIALGLFSMFASYMTALFTFLYLRFTSPQYNSNGAYNGALMAFSFVIALQICNIATEAIRSGTATFFVALGNDPEVFHHSYPHRFDEIFRAYPDVLRKLSHQNV

SEQ ID NO: 742 - protein, 312 aa, Saccharomyces cerevisiae
  misc_feature (0)...(0): Polypeptide Accession Number YOR164C
MVPAESNAVQAKLAKTLQRFENKIKAGDYYEAHQTLRTIANRYVRSKSYEHAIELISQGALSFLKAKQGGSGTDLIFYLLEVYDLAEVKVDDISVARLVRLIAELDPSEPNLKDVITGMNNWSIKFSEYKFGDPYLHNTIGSKLLEGDFVYEAERYFMLGTHDSMIKYVDLLWDWLCQVDDIEDSTVAEFFSRLVFNYLFISNISFAHESKDIFLERFIEKFHPKYEKIDKNGYEIVFFEDYSDLNFLQLLLITCQTKDKSYFLNLKNHYLDFSQAYKSELEFLGQEYFNIVAPKQTNFLQDMMSGFLGGSK

SEQ ID NO: 743 - protein, 284 aa, Saccharomyces cerevisiae
  misc_feature (0)...(0): Polypeptide Accession Number YOR174W
MSVQDTKAVEFSMGHIRSSSVSLVAEATSNTNSEDKLSKVQLYEDLCRYEDTLSKLVESVDRFKPNLDIAKDLIRTDEALFENVKLLAEYDNIYRNLQKIDKDSEELDSKTRKILEILNECHDELKALPMLEQVEFEKNTILQQRSKINSTELLDYATKLSKFTKIPPTFDKGAVGPNNFIWPAEDALRRGMLAMASLHSKELTRIPGEEVEETEVPTVPPSQSEEQKGQMAKKEGTPKTDSFIFDGTAKEVGDEADNTKDKEKEENNDDALDLDLDLFDPDDF

SEQ ID NO: 744 - protein, 271 aa, Saccharomyces cerevisiae
  misc_feature (0)...(0): Polypeptide Accession Number YOR180C
MSSRVCYHINGPFFIIKLIDPKHLNSLTFEDFVYIALLLHKANDIDSVLFTVLQSSGKYFSSGGKFSAVNKLNDGDVTSEVEKVSKLVSAISSPNIFVANAFAIHKKVLVCCLNGPAIGLSASLVALCDIVYSQNDSVFLLFPFSNLGFVAEVGTSVTLTQKLGINSANEHMIFSTPVLFKELIGTIITKNYQLTNTETFNEKVLQDIKQNLEGLYPKSVLGMKELLHSEMKQKLIKAQAMETNGTLPFWASGEPFKRFKQLQEGNRRHKL

SEQ ID NO: 745 - protein, 220 aa, Saccharomyces cerevisiae
  misc_feature (0)...(0): Polypeptide Accession Number YOR185C
MSAPAQNNAEVPTFKLVLVGDGGTGKTTFVKRHLTGEFEKKYIATIGVEVHPLSFYTNFGEIKFDVWDTAGQEKFGGLRDGYYINAQCAIIMFDVTSRITYKNVPNWHRDLVRVCENIPIVLCGNKVDVKERKVKAKTITFHRKKNLQYYDISAKSNYNFEKPFLWLARKLAGNPQLEFVASPALAPPEVQVDEQLMHQYQQEMDQATALPLPDEDDADL

SEQ ID NO: 746 - protein, 453 aa, Saccharomyces cerevisiae
  misc_feature (0)...(0): Polypeptide Accession Number YOR197W
MKMSLEVYLNYHQRRPTRFTIMYPGSGRYTYNNAGGNNGYQRPMAPPPNQQYGQQYGQQYEQQYGQQYGQQNDQQFSQQYAPPPGPPPMAYNRPVYPPPQFQQEQAKAQLSNGYNNPNVNASNMYGPPQNMSLPPPQTQTIQGTDQPYQYSQCTGRRKALIIGINYIGSKNQLRGCINDAHNIFNFLTNGYGYSSDDIVILTDDQNDLVRVPTRANMIRAMQWLVKDAQPNDSLFLHYSGHGGQTEDLDGDEEDGMDDVIYPVDFETQGPIIDDEMHDIMVKPLQQGVRLTALFDSCHSGTVLDLPYTYSTKGIIKEPNIWKDVGQDGLQAAISYATGNRAALIGSLGSIFKTVKGGMGNNVDRERVRQIKFSAADVVMLSGSKDNQTSADAVEDGQNTGAMSHAFIKVMTLQPQQSYLSLLQNMRKELAGKYSQKPQLSSSHPIDVNLQFIM

SEQ ID NO: 747 - protein, 220 aa, Saccharomyces cerevisiae [sequence omitted]

SEQ ID NO: 748 - protein, 70 aa, Saccharomyces cerevisiae
  misc_feature (0)...(0): Polypeptide Accession Number YOR210W
MIVPVRCFSCGKVVGDKWESYLNLLQEDELDEGTALSRLGLKRYCCRRMILTHVDLIEKFLRYNPLEKRD

SEQ ID NO: 749 - protein, 423 aa, Saccharomyces cerevisiae
  misc_feature (0)...(0): Polypeptide Accession Number YOR212W
MAAHQMDSITYSNNVTQQYIQPQSLQDISAVEDEIQNKIEAARQESKQLHAQINKAKHKIQDASLFQMANKVTSLTKNKINLKPNIVLKGHNNKISDFRWSRDSKRILSASQDGFMLIWDSASGLKQNAIPLDSQWVLSCAISPSSTLVASAGLNNNCTIYRVSKENRVAQNVASIFKGHTCYISDIEFTDNAHILTASGDMTCALWDIPKAKRVREYSDHLGDVLALAIPEEPNSENSSNTFASCGSDGYTYIWDSRSPSAVQSFYVNDSDINALRFFKDGMSIVAGSDNGAINMYDLRSDCSIATFSLFRGYEERTPTPTYMAANMEYNTAQSPQTLKSTSSSYLDNQGVVSLDFSASGRLMYSCYTDIGCVVWDVLKGEIVGKLEGHGGRVTGVRSSPDGLAVCTGSWDSTMKIWSPGYQ

SEQ ID NO: 750 - protein, 185 aa, Saccharomyces cerevisiae
  misc_feature (0)...(0): Polypeptide Accession Number YOR215C
MFRQSIRPLVSNRLTFIRYNSSPAYTAAVSLLKGDLKKAMIAKDEMKKTAIRNMLSAIKNKEIALKGKSADEYSLYDMYSKLISQRKDSINEFLANKRDDLVAKEQGEMDIIKKYMDQLPVSSELDIDQNVKKLLDALKTKAGEKKVQIKEIMGEIDWKSLPTEWKTSPTAIKNSIVKQFKEIFK

SEQ ID NO: 751 - protein, 265 aa, Saccharomyces cerevisiae
  misc_feature (0)...(0): Polypeptide Accession Number YOR220W
MANQKQMRTQILITDIPSGKFTSKWPTQLEKTLFKEQFPNLQSHLQYYTPLPFLNRIIIIFDNEDDTLQVFKFLQELLAKENSGPMKLFVTESLLNNQHPRSRSTDDAVSLQDNNLALLEDHRNKPLLSINTDPGVTGVDSSSLNKGGSSLSPDKSSLESPTMLKLSTDSKPFSYQEPLPKLSRSSSSTSNLSLNRSSQTSLPSQLENKDKSASGTKCLFASKPLGLTIDTSTRSNAASCTENDVNATASNPPKSPSITVNEFFH

SEQ ID NO: 752 - protein, 156 aa, Saccharomyces cerevisiae
  misc_feature (0)...(0): Polypeptide Accession Number YOR226C
MFARLANPAHFKPLTGSHITRAAKRLYHPKVIDHYTNPRNVGSMDKSLANVGTGIVGAPACGDVIKLQIQVNDKSGIIENVKFKTFGCGSAIASSSYMTELVRGMSLDEAVKIKNTEIAKELSLPPVKLHCSMLAEDAIKAAIKDYKTKRNPSVLH

SEQ ID NO: 753 - protein, 347 aa, Saccharomyces cerevisiae
  misc_feature (0)...(0): Polypeptide Accession Number YOR262W
MPFAQIVIGPPGSGKSTYCNGCSQFFNAIGRHSQVVNMDPANDALPYPCAVDIRDFITLEEIMQEQQLGPNGGLMYAVESLDNSIDLFILQIKSLVEEEKAYLVFDCPGQVELFTHHSSLFNIFKKMEKELDIRFCVVNLIDCFYMTSPSQYISILLLALRSMLMMDLPHINVFSKIDMLKSYGELPFRLDYYTEVQDLDYLEPYIEKEGSSVLGKKYSKLTETIKELVSDFNLVSFEVLSVDDKESMINLQGVIDKANGYIFGASEVGGDTVWAEASREGALIANYDIQDRWIDNKEKYDKEEEEKRTALLKEQELQNKAVDVNEEDEWENALKEWEEKQGMDFVR

SEQ ID NO: 754 - protein, 430 aa, Saccharomyces cerevisiae
  misc_feature (0)...(0): Polypeptide Accession Number YOR264W
MPRKFLGNKIEKNVDAVRPSSLTLTADDLKYIPPIPQDFEDEDDKVLRTSNGGNRLSKRFGGTLKLKKRLESVPELFLHDFKKRPRSQLEVIREKKFTDMQVPKGPVCPQSTILPLRERKKVKSLPIQRKSLRRPTLSKPAVVQSLGHKTHSDHIIDKVFVSRPAPIVMPVKALTPINPVSLMQTQTQDCCRKNKYGKSGSEILFDEILSAYENVSTSDSTALNSEIDRIIDICASKQIAKKNEAFQVPYVVCPDDTETLFSSTTPKLKPVNSNTLNDVISSPEYTTSGCSTYSDQSNSDEELSEVESIVWNTNKRTMRSSIVSESTSEEGYCTAAETLPSTVSVEDLDIHNKLPKVAQTSSCNTLLNKLSIRKLKKVILDPPKIMHVMTFDDDSDDGDDNDDEDRALNILQKKIDCIEIASCSSSIYSE

SEQ ID NO: 755 - protein, 494 aa, Saccharomyces cerevisiae
  misc_feature (0)...(0): Polypeptide Accession Number YOR269W
MTNWQQQLPLTDTQKNELDKSVLRYLNWNYKQTVRHEHAQDYESVRHAIVTLSGFLLQESVDRQEFISNNDTSNESMVDIDELLLPKKWNSIVRLQKKIIELEQNTETLVSQIKDLNTQVSELAQFKPTTSNGTSAHNVLKWIPRNLPSCLINVESSVTSVKLHPNLPIVFVATDHGKLYAFDLFNYTIPLASLQSHTKAITSMDVLFTNYTNSSKKNYLVIVTASKDLQIHVFKWVSEECKFQQIRSLLGHEHIVSAVKIWQKNNDVHIASCSRDQTVKIWDFHNGWSLKTFQPHSQWVRSIDVLGDYIISGSHDTTLRLTHWPSGNGLSVGTGHEFPIEKVKFIHFIEDSPEIRFRTPSTDRYKNWGMQYCVSASRDRTIKIWEIPLPTLMAHRAPIPNPTDSNFRCVLTLKGHLSWVRDISIRGQYLFSCADDKSVRCWDLNTGQCLHVWEKLHTGFVNCLDLDVDFDSNVTPRQMMVTGGLDCKSNVFMR

SEQ ID NO: 756 - protein, 161 aa, Saccharomyces cerevisiae
  misc_feature (0)...(0): Polypeptide Accession Number YOR276W
MIKYTIDELFQLKPSLTLEVNFDAVEFRAIIEKVKQLQHLKEEEFNSHHVGHFGRRRSSHHHGRPKIKHNKPKVTTDSDGWCTFEAKKKGSGEDDEEETETTPTSTVPVATIAQETLKVKPNNKNISSNRPADTRDIVADKPILGFNAFAALESEDEDDEA

SEQ ID NO: 757 - protein, 243 aa, Saccharomyces cerevisiae
  misc_feature (0)...(0): Polypeptide Accession Number YOR284W
MQQTKFGKMYLDHDSVVEYSEDEIVEADRITLGYKKRLSMIENQMRHLLEDFSLDVQQIEPILADLQKYYDAFLQLLQKRNKSLQCKRSTHQPVPSPMNSQTSTNAKVNLSGKLMKFQLNSVQKFDEENILRILQNKIEFEHYFQIDKGKKQKVLLLAVYQCLNGPTRLHKVLNIEGIIHNNSIRTILGKQVSSSKWTVFLYDVKLVLLAHRQDVPNLETSKMIVRYGDLFPCALYFKDHTAY

SEQ ID NO: 758 - protein, 411 aa, Saccharomyces cerevisiae
  misc_feature (0)...(0): Polypeptide Accession Number YOR303W
MSSAATKATFCIQNGPSFEGISFGANKSVAGETVFTTSLVGYPESMTDPSYRGQILVFTQPLIGNYGVPSGEARDEYNLLKYFESPHIHVVGIVVAEYAYQYSHWTAVESLAQWCQREGVAAITGVDTRELVQYLREQGSSLGRITLADHDPVPYVNPMKTNLVAQVTTKKPFHVSALPGKAKANVALIDCGVKENIIRCLVKRGANVTVFPYDYRIQDVASEFDGIFLSNGPGNPELCQATISNVRELLNNPVYDCIPIFGICLGHQLLALASGASTHKLKYGNRAHNIPAMDLTTGQCHITSQNHGYAVDPETLPKDQWKPYFVNLNDKSNEGMIHLQRPIFSTQFHPEAKGGPLDTAILFDKFFDNIEKYQLQSQAKSSISLKVTYSTDKSRLQSINVTKLAKERVLF

SEQ ID NO: 759 - protein, 185 aa, Saccharomyces cerevisiae
  misc_feature (0)...(0): Polypeptide Accession Number YOR331C
MSSFIDSIKSTSLSRALTIALGSNNFKSASTINDCKMGLYSSRLLAIPDNFSLVSSNIPSSDCSRAERTFNLILFAIVDLVICCESMAFFNLLLKLPSMLLVSFLTMLVFSISYSWSAFNWISFAFSSASFLMKACILFNSSFTWFGVKAVIAEDMLYRMVRGLFCASFVKQLQTTFLATAIVLC

SEQ ID NO: 760 - protein, 627 aa, Saccharomyces cerevisiae
  misc_feature (0)...(0): Polypeptide Accession Number YOR348C
MVNILPFHKNNRHSAGVVTCADDVSGDGSGGDTKKEEDVVQVTESPSSGSRNNHRSDNEKDDAIRMEKISKNQSASSNGTIREDLIMDVDLEKSPSVDGDSEPHKLKQGLQSRHVQLIALGGAIGTGLLVGTSSTLHTCGPAGLFISYIIISAVIYPIMCALGEMVCFLPGDGSDSAGSTANLVTRYVDPSLGFATGWNYFYCYVILVAAECTAASGVVEYWTTAVPKGVWITIFLCVVVILNFSAVKVYGESEFWFASIKILCIVGLIILSFILFWGGGPNHDRLGFRYWQHPGAFAHHLTGGSLGNFTDIYTGIIKGAFAFILGPELVCMTSAECADQRRNIAKASRRFVWRLIFFYVLGTLAISVIVPYNDPTLVNALAQGKPGAGSSPFVIGIQNAGIKVLPHIINGCILTSAWSAANAFMFASTRSLLTMAQTGQAPKCLGRINKWGVPYVAVGVSFLCSCLAYLNVSSSTADVFNWFSNISTISGFLGWMCGCIAYLRFRKAIFYNGLYDRLPFKTWGQPYTVWFSLIVIGIITITNGYAIFIPKYWRVADFIAAYITLPIFLVLWFGHKLYTRTWRQWWLPVSEIDVTTGLVEIEEKSREIEEMRLPPTGFKDKFLDALL

SEQ ID NO: 761 - protein, 791 aa, Saccharomyces cerevisiae
  misc_feature (0)...(0): Polypeptide Accession Number YOR353C
MVATSSKRTLDPKEEHLPADKTSTNSSNTIISELATQEKSSSSGTTLKLIALNIKSISDEDVGYIQNVERLSLRKNHLTSLPASFKRLSRLQYLDLHNNNFKEIPYILTQCPQLEILDLSSNEIEALPDEISSFWQDNIRVLSLKDNNVTSIRNLKSITKLNKLSILDLEDNKIPKEELDQVQSYTPFHTGIPKEEYWAIAISRYLKDHPNLPTPEPKISRAAKRMGFINTNLSNGAMNENNIISLAPSANTTISASTAMVSSNQTSATSFSGTVNAESEQSGAVNGTELYNHTKYNDYFKRLSILPEESMSNGHQKISHAELVVSCRKLLFSFTECQQAIRKIASFCKEKAVAVNVVSLLYSVRSHTDNLVEVLQQTENEDESHDQALIKLCLTIITNFKQIITLLRKNFEIFFKEDDLCFIRMFYMTLMCAYMEMYNAWSFIKEDDQVSGSASKAPKKHSFSRHETSSSSITSGGGPAASTTSTHCSGNIKLLPKTRSTRTPSASALLSNSNILTGDTTAVPLLSPNLNGAHTHGPILGHQNAISNGSSQTNMNEVKTTSDTIPRQQLLQHNKSISDSKKESQAHEPKQHPVMTSSIINASNSNNVSNVNITPPPMNGGGAANSSANVVETNIDIQLYQTLSTVVKMVSVVYNQLTSEISKIAIASTMGKQILTDSLAPKIRDLTETCRQAMDLSKQLNERLNVLIPNDSNSEKYLTSLEKLKTWEIMNSFLKVIISILANTKIVMSDVPNLNELRPNLANLAKITKDVTVILDLSSYKAVSVSANSPE

SEQ ID NO: 762 - protein, 522 aa, Saccharomyces cerevisiae
  misc_feature (0)...(0): Polypeptide Accession Number YOR355W
MALANSRPLQIPTLENEILHNSNSPVFQLNSMGFTTRADTISNPGTDLIGNQPGMALDDNNLAGSSFSSSQEIKATKPKKDFGAPKKDNPLLEISKLIPVTGERPKPENRDSPLDDDVLHAVFLILWEMDPNQQGMTVKQLCDLLLQKHPDMSNLSTKLSNLISAKLNAYVKKIEKGEKTLTYALSREWSNSSPRRMLYIYRGILSPDYKEHAQAVTMQLKQQLETSGDTSDFNSNGKKKRESSSNQLVNNDSYSSSMTDMKNMSSNSSFSKNLNVGNLAFSLSPEFNIPYSTSPVSLNLSPSMSNNQQQLLTPNSASKSKNNNKKRNYMDEDTNESMTEPKKTKTTKPGKQTKSQSLSVLSTPKKGSSASLSTFASSKNISPDSSLSHNASSNTYVTAAAAAPRLSKLLPKNGFKKNSRSSSELAAIHKVISTQTPIESSSESSQYNSSSSSPVNSAAASSAESLSDINSSQDNGRESNPSSQESRNEVTNWMKIVRNGFLTHDIESPESITLDDLENIFN

SEQ ID NO: 763 - protein, 242 aa, Saccharomyces cerevisiae
  misc_feature (0)...(0): Polypeptide Accession Number YOR358W
MTDRNFSPQQGQGPQESLPEGPQPSTMIQREEMNMPRQYSEQQQLQENEGEGENTRLPVSEEEFRMVQELQAIQAGHDQANLPPSGRGSLEGEDNGNSDGADGEMDEDDEEYDVFRNVGQGLVGHYKEIMIRYWQELINEIESTNEPGSEHQDDFKSHSLPFARIRKVMKTDEDVKMISAEAPIIFAKACEIFITELTMRAWCVAERNKRRTLQKADIAEALQKSDMFDFLIDVVPRRPLPQ

SEQ ID NO: 764 - protein, 288 aa, Saccharomyces cerevisiae
  misc_feature (0)...(0): Polypeptide Accession Number YOR362C
MTSIGTGYDLSNSVFSPDGRNFQVEYAVKAVENGTTSIGIKCNDGVVFAVEKLITSKLLVPQKNVKIQVVDRHIGCVYSGLIPDGRHLVNRGREEAASFKKLYKTPIPIPAFADRLGQYVQAHTLYNSVRPFGVSTIFGGVDKNGAHLYMLEPSGSYWGYKGAATGKGRQSAKAELEKLVDHHPEGLSAREAVKQAAKIIYLAHEDNKEKDFELEISWCSLSETNGLHKFVKGDLLQEAIDFAQKEINGDDDEDEDDSDNVMSSDDENAPVATNANATTDQEGDIHLE

SEQ ID NO: 765 - protein, 401 aa, Saccharomyces cerevisiae
  misc_feature (0)...(0): Polypeptide Accession Number YOR368W
MRINSELANKFSASTVHLEHITTALSCLTPFGSKDDVLIFIDADGLSFVRENNHVIKIQLLLSRELFMSYSYRNETEDHMKLCVKINHILDSVSVMNRNSDDIVECTLSYDGHGSPFVLIFEDSFISERVEYSTYLIKDFDTNGLELDRERISFEAIIKGEALHSALKDLKEIGCKECYVYAKTEANDENVFALISKSQLGFSKIKLPSNRSILEKLQVFDGDSTTVIDGFAVIGFFDFTSFDKIRKSTKIASKVLFRMDVHGVLSVNILSQTDDVIITDTTRPSNNRPGSIRQLQLPKDYPGIVIEVCMLEKESIDEAAQTEIELLMETNELGNRNSFKKSTIRKRYGTDKGNETSNDNLLQLNGKKIKLPSEEENNKNRESEDEENHCKYPTKDIPIFF

SEQ ID NO: 766 - protein, 554 aa, Saccharomyces cerevisiae
  misc_feature (0)...(0): Polypeptide Accession Number YOR372C
MDRDISYQQNYTSTGATATSSRQPSTDNNADTNFLKVMSEFKYNFNSPLPTTTQFPTPYSSNQYQQTQDHFANTDAHNSSSNESSLVENSILPHHQQIQQQQQQQQQQQQQQQALGSLVPPAVTRTDTSETLDDINVQPSSVLQFGNSLPSEFLVASPEQFKEFLLDSPSTNFNFFHKTPAKTPLRFVTDSNGAQQSTTENPGQQQNVFSNVDLNNLLKSNGKTPSSSCTGAFSRTPLSKIDMNLMFNQPLPTSPSKRFSSLSLTPYGRKILNDVGTPYAKALISSNSALVDFQKARKDITTNATSIGLENANNILQRTPLRSNNKKLFIKTPQDTINSTSTLTKDNENKQDIYGSSPTTIQLNSSITKSISKLDNSRIPLLASRSDNILDSNVDDQLFDLGLTRLPLSPTPNCNSLHSTTTGTSALQIPELPKMGSFRSDTGINPISSSNTVSFKSKSGNNNSKGRIKKNGKKPSKFQIIVANIDQFNQDTSSSSLSSSLNASSSAGNSNSNVTKKRASKLKRSQSLLSDSGSKSQARKSCNSKSNGNLFNSQ

SEQ ID NO: 767 - protein, 454 aa, Saccharomyces cerevisiae
  misc_feature (0)...(0): Polypeptide Accession Number YOR375C
MSEPEFQQAYEEVVSSLEDSTLFEQHPEYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQYAALKVIELGGTVVSLSDSKGCIISETGITSEQVADISSAKVNFKSLEQIVNEYSTFSENKVQYIAGARPWTHVQKVDIALPCATQNEVSGEEAKALVAQGVKFIAEGSNMGSTPEAIAVFETARSTATGPSEAVWYGPPKAANLGGVAVSGLEMAQNSQRITWTSERVDQELKRIMINCFNECIDYAKKYTKDGKVLPSLVKGANIASFIKVSDAMFDQGDVF

SEQ ID NO: 768 - protein, 233 aa, Saccharomyces cerevisiae
  misc_feature (0)...(0): Polypeptide Accession Number YPL002C
MKQFGLAAFDELKDGKYNDVNKTILEKQSVELRDQLMVFQERLVEFAKKHNSELQASPEFRSKFMHMCSSIGIDPLSLFDRDKHLFTVNDFYYEVCLKVIEICRQTKDMNGGVISFQELEKVHFRKLNVGLDDLEKSIDMLKSLECFEIFQIRGKKFLRSVPNELTSDQTKILEICSILGYSSISLLKANLGWEAVRSKSALDEMVANGLLWIDYQGGAEALYWDPSWITRQL

SEQ ID NO: 769 - protein, 462 aa, Saccharomyces cerevisiae
  misc_feature (0)...(0): Polypeptide Accession Number YPL003W
MERYDRQLRLWGALGQDSLNRSRVCVVGPATPLLQEVFKNLVLAGISSLTWLKVECAVQSGSLFLAELKKDLEPLASKQLEYEENDLRKTLQQPQYDWTRFSVVILTCIGEQTAMLDLNEIRRQRGTKFPPVLNTFVSGFYGYIYLVLSETHFVLQAHPDSKKYDLRLQNPWPELINYVDTFDLSKMDTATFSGIPYTVLLMKCIAKLERDGNNGRITIDQMKKVLDQICLPLGNDVIYEPNYVEAKRYAYLACSQNDCCKELEDLLRNLEISDYGNDWHDTYNYEILTLLLTLKNIAKENGELSFQPLTGTLPDMESTTENYIRLKKLYEVKAKLDKSRVEESLARSKKIVSQDVLETFCSHYGEVRKILPPKSDLLGIFSTSNALLDALVMVQFWEQPAVTAEDKDEFIGLRVDDNYSVMAFFGGAVVQEAIKLITHHYVPIDNLFLYNGINNSSATYKI

SEQ ID NO: 770 - protein, 835 aa, Saccharomyces cerevisiae
  misc_feature (0)...(0): Polypeptide Accession Number YPL019C
MLFGIKLANDVYPPWKDSYIDYERLKKLLKESVIHDGRSSVDSWSERNESDFVEALDKELEKVYTFQISKYNAVLRKLDDLEENTKSAEKIQKINSEQFKNTLEECLDEAQRLDNFDRLNFTGFIKIVKKHDKLHPNYPSVKSLLQVRLKELPFNNSEEYSPLLYRISYLYEFLRSNYDHPNTVSKSLASTSKLSHFSNLEDASFKSYKFWVHDDNIMEVKARILRHLPALVYASVPNENDDFVDNLESDVRVQPEARLNIGSKSNSLSSDGNSNQDVEIGKSKSVIFPQSYDPTITTLYFDNDFFDLYNNRLLKISGAPTLRLRWIGKLLDKPDIFLEKRTFTENTETGNSSFEEIRLQMKAKFINNFIFKNDPSYKNYLINQLRERGTQKEELEKLSRDFDNIQNFIVEEKLQPVLRATYNRTAFQIPGDQSIRVTIDSNIMYIREDSLDKNRPIRNPENWHRDDIDSNIPNPLRFLRAGEYSKFPYSVMEIKVINQDNSQMPNYEWIKDLTNSHLVNEVPKFSLYLQGVASLFGEDDKYVNILPFWLPDLETDIRKNPQEAYEEEKKTLQKQKSIHDKLDNMRRLSKISVPDGKTTERQGQKDQNTRHVIADLEDHESSDEEGTALPKKSAVKKGKKFKTNAAFLKILAGKNISENGNDPYSDDTDSASSFQLPPGVKKPVHLLKNAGPVKVEAKVWLANERTFNRWLSVTTLLSVLTFSIYNSVQKAEFPQLADLLAYVYFFLTLFCGVWAYRTYLKRLTLIKGRSGKHLDAPVGPILVAVVLIVTLVVNFSVAFKEAARRERGLVNVSSQPSLPRTLKPIQDFIFNLVGE

SEQ ID NO: 771 - protein, 305 aa, Saccharomyces cerevisiae
  misc_feature (0)...(0): Polypeptide Accession Number YPL031C
MSSSSQFKQLEKLGNGTYATVYKGLNKTTGVYVALKEVKLDSEEGTPSTAIREISLMKELKHENIVRLYDVIHTENKLTLVFEFMDNDLKKYMDSRTVGNTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHAS

SEQ ID NO: 772 - protein, 316 aa, Saccharomyces cerevisiae
  misc_feature (0)...(0): Polypeptide Accession Number YPL039W
MLKEEYNLSGADNMASAELSFKKQKVVLKKFMIAQVTKGIMQRYASLLVTMPSDDDNAIIGTNHLKTTKFLEIILHRAKSSHLQFKKVCCIVIKFLDCCSKETNYMKFLKFSLHKLFVAAFILSVPNVVGDDRDRITTRDETYHLYSQITGLPLEEVINCCSIVRPVLIRRSRQQRRQMLSRREQHSYFLRSSFMNSNSSASPFFSTNRSADDLHVHTRAYSLHSHSDGEGQDRRSEHEETHSMGADADTYRQTTFIPDTPNGLHSRSLIECGIEPTQVSDSGEWSGQSNGYVLVTELQEFNKMGKKLVQEAFRIV

SEQ ID NO: 773 - protein, 452 aa, Saccharomyces cerevisiae
  misc_feature (0)...(0): Polypeptide Accession Number YPL049C
MAVSARLRTTAEDTSIAKSTQDPIGDTEISVANAKGSSDSNIKNSPGGNSVGQESELEHVPEEDDSGDKEADHEDSETATAKKRKAQPLKNPKKSLKRGRVPAPLNLSDSNTNTHGGNIKDGNLASSNSAHFPPVANQNVKSAPAQVTQHSKFQPRVQYLGKASSRQSIQVNNSSNSYGKPHMPSAGIMSAMNPYMPMNRYIMSPYYNPYGIPPPHMLNKPIMTPYVSYPYPMGPRTSIPYAMQGGNARPYEENEYSASNYRNKRVNDSYDSPLSGTASTGKTRRSEEGSRNSSVGSSANAGPTQQRADLRPADMIPAEEYHFERDALLSANTKARSASTSTSTSTSTNRDRSSWHEAEPNKDEEEGTDLAIEDGAVPTPTFTTFQRTSQPQQQSPSLLQGEIRLSSHIFAFEFPLSSSNVDKKMFMSICNKVWNESKELTKKSSSHHRTGK

SEQ ID NO: 774 - protein, 150 aa, Saccharomyces cerevisiae
  misc_feature (0)...(0): Polypeptide Accession Number YPL059W
MFLPKFNPIRSFSPILRAKTLLRYQNRMYLSTEIRKAIEDAIESAPVVLFMKGTPEFPKCGFSRATIGLLGNQGVDPAKFAAYNVLEDPELREGIKEFSEWPTIPQLYVNKEFIGGCDVITSMARSGELADLLEEAQALVPEEEEETKDR

SEQ ID NO: 775 - protein, 612 aa, Saccharomyces cerevisiae
  misc_feature (0)...(0): Polypeptide Accession Number YPL070W
MARQLFTPPITNPRFDPNQSIRESYKNTTGGMQFQQNLHEDQNDNERSSCDGDENSTTGERLENNKSPILTKQEIDEALNTVTNLPPELSKLIDIFIDDLKQPKYVRPLSVLQLSSLFQSFYIKFDKASFQHVSSANNNGYYFSGGGSSSFLAAKETLSSGLSGIFGRSRSSSGNSLMRPRRSSSLFSNESISNSTNATQMLSPEEIKKQLKINELNNMKIEKYMELCERDVFKKILIVGTSVSSPNKMKTFKPHQLQTFKVGNLFRNSVEFTEYNKLLNEKILCLSKLSTMNKINLIKFLSLNNGIDPEPKFEEIKDILYEFTYHSISPCEKIKALLKLHEIMTYSQEMSNDDYLSLLIYYIITIVPRDIFLNAEFIRLFRYKKKLVETESFALTNLEAALVFVEGLTKNDFSNELQDKLTVNESKILENSISSRVSLPSKTAIMHKNNGNNGSNLGDIVTPTIQRPDVTRSNSYDGFRTVFDSSLKNIIGKIRSYTPPHPNNTSNNNLHSSNNLNIPRSSSQLSMELSNRDTTEMSRDGSRSTSSSSRSSASLEHGNREFTGDLTVTASINGADKKEFQKSWKKYKGYKFEDLTICELRDLFEIYQKMMQ

SEQ ID NO: 776 - protein, 342 aa, Saccharomyces cerevisiae
  misc_feature (0)...(0): Polypeptide Accession Number YPL088W
MVLVKQVRLGNSGLKISPIVIGCMSYGSKKWADWVIEDKTQIFKIMKHCYDKGLRTFDTADFYSNGLSERIIKEFLEYYSIKRETVVIMTKIYFPVDETLDLHHNFTLNEFEELDLSNQRGLSRKHIIAGVENSVKRLGTYIDLLQIHRLDHETPMKEIMKALNDVVEAGHVRYIGASSMLATEFAELQFTADKYGWFQFISSQSYYNLLYREDERELIPFAKRHNIGLLPWSPNARGMLTRPLNQSTDRIKSDPTFKSLHLDNLEEEQKEIINRVEKVSKDKKVSMAMLSIAWVLHKGCHPIVGLNTTARVDEAIAALQVTLTEEEIKYLEEPYKPQRQRC

SEQ ID NO: 777 - protein, 1223 aa, Saccharomyces cerevisiae
  misc_feature (0)...(0): Polypeptide Accession Number YPL110C
MKFGKTFANHRIPEWSSQYVGYKSLKKMIKEITRLQEDIYRAHNKNSYDEGRPPTKMRDSSNSAQNYLDSPKIQKLLASFFFAVDRDIEKVDTFYNSQYAEYKKRFERLLSSNQFNEIKSTLVVDANKEDAVAQTLLTKDTREMNMLLKGTSQASRLSYHKDDLIEIQSILAELRKQFRNLKWYAELNKRAFGKILKKLDKKVGTNQQMSTMKTRILPLQFANDSLITKDLSLLKTIWEQVTFRINSYERVMRSTSPNANANDNTEFFKIICVFIEEDDSKGLIRELTNLYSELSLIPTRIMISVLNKAALSKSLACIDAILKVIPSLNDSEDINRRNFFHHHIIAIGKLIRKQEILSRKKKSQPSKYTNSEGEIVTDLRTLHTTLSAPAESDSITEEEKSSACTLSYILEELPIHLRPCLFQHDNYKRTPLHYSCQYGLSEVTKLIIKLMKEWNIWNEIPIDDVSAFGDAESLTPLHLCVLGAHPKTTEVLLQSLDPNVKLKSSSLLHLATEWNNYPLLHVLLSSKRFDINYQDNELHETPLYLACRLNFFEAAVCLLYNGADLEIREKLFGWTAIFVAAAEGFTDIVKLLIANNANFDIEDEGGWTPMEHAVLRGHLHIADMVQIRDELVTHPHSQLNSGSEEKEPLNEISAGELNERNENGNGGNKGSLGKLAGPIKSYGHRFLDNNESLILITLGSNDTRNKSPSISLSSEALAKVIGLETDCALSLVISCNDSIDKSSVILDLPLDDNVDAVDFKVPFKVDYSHTLYFDIVPTYGTRSLETHNRIDCQKNNNNYVMARGVSMLNKSYSSVGVNRSILNGSVTVPIIANHTLEILGTLKFEYIIITPFEHPQLPLERTETYWKSLVSTRVIGHRGLGKNNPNKSLQIGENTVESFIMAASLGASYVEFDVQLTKDNVPVVYHDFLVAETGVDIPMHELTLEQFLDLNNADKEHIQRGAGHSPHHVNGADTALQKYRGRSVDDSDVSTLRRAWDLHDNDPNGKSNNAHWSDNRMRLTKTFKKNNFKGNARGHSIASSFVTLKELFKKIPANVGFNIECKFPMLDEAEEEELGQIMMEMNHWVDTVLKVVFDNANGRDIIFSSFHPDICIMLSLKQPVIPILFLTEGGSEQMADLRASSLQNGIRFAKKWNLLGIVSAAAPILKAPRLVQVVKSNGLVCVTYGVDNNDPENASIQIEAGVDAVIVDSVLAIRRGLTKKNEK

SEQ ID NO: 778 - protein, 333 aa, Saccharomyces cerevisiae
  misc_feature (0)...(0): Polypeptide Accession Number YPL111W
METGPHYNYYKNRELSIVLAPFSGGQGKLGVEKGPKYMLKHGLQTSIEDLGWSTELEPSMDEAQFVGKLKMEKDSTTGGSSVMIDGVKAKRADLVGEATKLVYNSVSKVVQANRFPLTLGGDHSIAIGTVSAVLDKYPDAGLLWIDAHADINTIESTPSGNLHGCPVSFLMGLNKDVPHCPESLKWVPGNLSPKKIAYIGLRDVDAGEKKILKDLGIAAFSMYHVDKYGINAVIEMAMKAVHPETNGEGPIMCSYDVDGVDPLYIPATGTPVRGGLTLREGLFLVERLAESGNLIALDVVECNPDLAIHDIHVSNTISAGCAIARCALGETLL

SEQ ID NO: 779 - protein, 562 aa, Saccharomyces cerevisiae
  misc_feature (0)...(0): Polypeptide Accession Number YPL128C
MDSQVPNNNESLNRFNDIIQSLPARTRLTICSLCLLDNISTQLLRFLILNANSPNIIAVLTDQTAFLSSGETEIFQTLVKLFKQIRMIYHTRSPLLSVHDVAPGLWFPNSPPPLILRGHEAFIITAIRKANLLTFLLTSLNCLNYGFELLQSIFLDIFCPNTNTVGNNSLEQSGKFLKSQAILYLDLKTQAYIAGLKEFQDETNEISLEKKQELLDLIFPSNLADILVQRRTGDSGDITLLTPSEKDFVERCDRRRENLKIVQDFNSLTQSYEWAQFIRELLDYCNKNMGLIIWGRKGRGKSPLYDFDVNEFDPQVLFSTGTRTVEFMDDQNQPSSASAFLSTARPNHYSTHTPTTDVSSKNPAITQSIVDAAVAASMSNSSSGPHSSHNNSSNSNNNGSIGLRKPKAKRTWSKEEEEALVEGLKEVGPSWSKILDLYGPGGKITENLKNRTQVQLKDKARNWKLQYLKSGKPLPDYLIKVTGNLEKIYKAKKKFSQSPNSSTIMEQNLSQHPSSAASATEDTQTHQEDSHGQNSDNMPSNGLFGNSTSDNTGFDPHLEDGM

SEQ ID NO: 780 - protein, 297 aa, Saccharomyces cerevisiae
  misc_feature (0)...(0): Polypeptide Accession Number YPL131W
MAFQKDAKSSAYSSRFQTPFRRRREGKTDYYQRKRLVTQHKAKYNTPKYRLVVRFTNKDIICQIISSTITGDVVLAAAYSHELPRYGITHGLTNWAAAYATGLLIARRTLQKLGLDETYKGVEEVEGEYELTEAVEDGPRPFKVFLDIGLQRTTTGARVFGALKGASDGGLYVPHSENRFPGWDFETEEIDPELLRSYIFGGHVSQYMEELADDDEERFSELFKGYLADDIDADSLEDIYTSAHEAIRADPAFKPTEKKFTKEQYAAESKKYRQTKLSKEERAARVAAKIAALAGQQ

SEQ ID NO: 781 - protein, 446 aa, Saccharomyces cerevisiae
  misc_feature (0)...(0): Polypeptide Accession Number YPL133C
MSANSGVKRASKAFKTCLFCKRSHVVCDKQRPCSRCVKRDIAHLCREDDIAVPNEMPSQHESSPNDNNIQGKYANKAHTGIPSDYQNEPVNKSGSTYGEELSPKLDSSLVNDTTSLLLPQQPVFVSENVGSEFSSLNEFLSMLENPLLTQTSLSSSSASNVHLENGSQTTQSPLEYQNDNRRDEIGVARQENRSPTIMSGSSNSISKGDKQDQEKEESRILANANENSAPTPKEQFFLTAADPSTEMTPEHRLKLVINAKLEAGLLKPYNYAKGYARLQDYMDKYMNQSSKQRILKPLSTIRPAFRTIARSLKDVDLVLVEESFERMLLSYDRVFTSMSMPACLCRRTGEIYRANKEFASLVDCTVDDLRDGKLAIYELMTEESAVNFWEKYGSIAFDKGQKAVLTSCSLRTKDGIRKRPCCFSFTIRRDRYNIPICIVGNFIPLS

SEQ ID NO: 782 - protein, 506 aa, Saccharomyces cerevisiae [sequence omitted]

SEQ ID NO: 783 - protein, 294 aa, Saccharomyces cerevisiae
  misc_feature (0)...(0): Polypeptide Accession Number YPL149W
MNDIKQLLWNGELNVLVSIDPSFLMKGSPREIAVLRIRVPRETYLVNYMPLIWNKIKSFLSFDPLTDSEKYFWFEHNKTPIPWNYPVGVLFDCLAGKSATFTTSFENQVKDVLTFLRIHLVMGDSLPPTIIPIASSKTQAEKFWFHQWKQVCFILNGSSKAIMSLSVNEARKFWGSVITRNFQDFIEISNKISSSRPRHIPLIIQTSRTSGTFRISQPTISMTGVNPTLKDIEGDILDVKEGINGNDVMVICQGIEIPWHMLLYDLYSKLRSFDGFLYITLVPIKGGDKASSEL

SEQ ID NO: 784 - protein, 451 aa, Saccharomyces cerevisiae
  misc_feature (0)...(0): Polypeptide Accession Number YPL151C
MDGNDHKVENLGDVDKFYSRIRWNNQFSYMATLPPHLQSEMEGQKSLLMRYDTYRKESSSFSGEGKKVTLQHVPTDFSEASQAVISKKDHDTHASAFVNKIFQPEVAEELIVNRYEKLLSQRPEWHAPWKLSRVINGHLGWVRCVAIDPVDNEWFITGSNDTTMKVWDLATGKLKTTLAGHVMTVRDVAVSDRHPYLFSVSEDKTVKCWDLEKNQIIRDYYGHLSGVRTVSIHPTLDLIATAGRDSVIKLWDMRTRIPVITLVGHKGPINQVQCTPVDPQVVSSSTDATVRLWDVVAGKTMKVLTHHKRSVRATALHPKEFSVASACTDDIRSWGLAEGSLLTNFESEKTGIINTLSINQDDVLFAGGDNGVLSFYDYKSGHKYQSLATREMVGSLEGERSVLCSTFDKTGLRLITGEADKSIKIWKQDETATKESEPGLAWNPNLSAKRF

SEQ ID NO: 785 - protein, 315 aa, Saccharomyces cerevisiae
  misc_feature (0)...(0): Polypeptide Accession Number YPL157W
MGRTFIHASKIKHAARKRKHHSNFRTLIKLLNNDAYKIESSKPLKNGKLFKYWKNRRRLFSKIDSASIYMTDELWFSVTPERIACFLANFVKACMPNAERILDVFCGGGGNTIQFAMQFPYVYGVDYSIEHIYCTAKNAQSYGVDDRIWLKRGSWKKLVSKQKLSKIKYDCVFGSPPWGGPEYLRNDVYDLEQHLKPMGITKMLKSFLKLSPNVIMFLPRNSDLNQLSRATRKVLGPFAKCKVLYVKENGYMKGIFCMWGECFFNYEPASTENSRRESSEKEELSSENEELSKRKKHESTTTTKDNTVDIYDVNG

SEQ ID NO: 786 - protein, 633 aa, Saccharomyces cerevisiae
  misc_feature (0)...(0): Polypeptide Accession Number YPL161C
MDYEEILFGLQPILNASSIKDVPMNDVYLGSYLAVMDQLAVSLREPSNRDIVGKTGLLLNLVRVLEQALDICFHDTSISINDKIAFYEISSEVIRCIANAIIDNDDNREILLDSGGKKLLNYYIGGVLQLDEISSDKSEDSLVDKLQMRSVVLLRNFCIGNLKYTENLAPFIRGPLFVLLKTTQYSYLSSPEKVVLGSDLLNDILKVNYSNVQISDLFFLSQYIKKISSNVQNKELQAMEDGAVEAYSNTETQKFAGQGNQEYIEKEEEDDEEDVNCELLLNLSTCLETIVAKDETINFTNEEQLVLSMQKNLILSLVCLESKTFNNKLIVMRRLISCAGNISANLTNSNKREQSLCIETIKSSASSYALAAALMILCNSVASKSDAVALLKLISLSELIQVGSLLQDPLQYQGFLDLLRKLLNLENTMWLDIKDLFTLFQIMRRCHEQTKYYNNLRSLLTNLLNKTLTVLPSSKIHNSISSDPTIISFIAEHGTLTSCIAMDKLLVSKKALPKEAITSLWDSIFKFQNLGQAEQLSISDLFHITKTVGIYLKDSSVTADVNPIENILFKDYIQKLTLILETILSFKENKDKGSESCFNNGKFIAGIILNIVKNTKCLTPEEQNLEALAKSFF

SEQ ID NO: 787 - protein, 868 aa, Saccharomyces cerevisiae
  misc_feature (0)...(0): Polypeptide Accession Number YPL174C
MRNAGVQVDTNMQKISLQDTVLVNEMKGRVKFIGETQFAKGIWYGIELDKPLGKNDGSANGIRYFDIDLKKANSNGGYYGLFCKKDTLQFYKPDDDEHSLLNGNAAQETIKNLQVKCESLASKLNKIKIENHELKTSVEKLSTNETVLLSKISRLDKLVKELKVENGNMKTHLDNFNHLLDASDSVMAPDLDKGTLLERSHLLQGLLDQTKLSYDKAMKVQEDLLEENTQLLEENAVLSKKISDLGLQLQQTNNTIGDLALQIEAQSKSSNIVDKLTNDNILLTSNIKALNNELEELQAKEKLDENLRITYEQLEQELRLQLSNLQSALENEKEIAGTYIEENSRLKATLESIEAKTSHKFQSLELKVNTLQEELYQNKLLKKFYQIYEPFAQPHLAALSSQLQYLAEVIESENFGKLENIEIHIILKVLSSISYALHIYTIKNTPDHLETTLQCFKVNIAPISMWLSEFLQRKFSSKQETAFSICQFLEDNKFLDKDVTLILKILHPILETTVPKLLAFLRTNSNFNDNDTLCLIGSLYERSLSLIARIDKLIGKEEISKQDNRLFLYPSCDITLSSILTILFSDALFLRQDYKRISSLKKLEVFFQGIESLLENITIFPEQPSQQTSDSESQCNIKEGNFSNSLLSDRLNEENIRLKEVLVQKENMLTELETKIKIIIGRDLERKTLEENIKTLKVELNNKNEENCGKTEILNKLKEENFNLVNRLKNMELKLYQIKDNNTLNKIYLDREKVDRVNLVSEIMELRETIRRQIKEQKRVSIDFSWLDELPAVENKQPFKEHINHSLDTLGIEMFNFVSTSRILDLKLDQPLAEDELWHERDHSYISYLKRKRKNIRLKSQNVVTYYK

SEQ ID NO: 788 - protein, 461 aa, Saccharomyces cerevisiae
  misc_feature (0)...(0): Polypeptide Accession Number YPL175W
MSSSHKVESYNNENRMLCDFFYPQLGGVEFHIYHLSQKLIDLGHSVVIITHAYKDRVGVRHLTNGLKVYHVPFFVIFRETTFPTVFSTFPIIRNILLREQIQIVHSHGSASTFAHEGILHANTMGLRTVFTDHSLYGFNNLTSIWVNKLLTFTLTNIDRVICVSNTCKENMIVRTELSPDIISVIPNAVVSEDFKPRDPTGGTKRKQSRDKIVIVVIGRLFPNKGSDLLTRIIPKVCSSHEDVEFIVAGDGPKFIDFQQMIESHRLQKRVQLLGSVPHEKVRDVLCQGDIYLHASLTEAFGTILVEAASCNLLIVTTQVGGIPEVLPNEMTVYAEQTSVSDLVQATNKAINIIRSKALDTSSFHDSVSKMYDWMDVAKRTVEIYTNISSTSSADDKDWMKMVANLYKRDGIWAKHLYLLCGIVEYMLFFLLEWLYPRDEIDLAPKWPKKTVSNETKEARET

SEQ ID NO: 789 - protein, 133 aa, Saccharomyces cerevisiae
  misc_feature (0)...(0): Polypeptide Accession Number YPL192C
MTAMKEDNAALITLKKNNDQEKLRVHKLTDASSNSADGFVINKAKNGGPLNKKSLVNNEQHIKKAVSPGRVRKHKTTTSSTKSRTKSKKKDASESKVQRENKGSFYQGAIFGSFLGAAVTTVLSNLAVKALQN

SEQ ID NO: 790 - protein, 461 aa, Saccharomyces cerevisiae
  misc_feature (0)...(0): Polypeptide Accession Number YPL201C
MGIPMQIYQDGKGVQFYHTRYQNVFDERASKYGNYTVNNDYPQLPDTIKEHIDQLTFSNVGEDGGDVGNYSEEDDDGDEEKELEDVFRSNRGLEFVRINNYFTTHDLQSFKSFRNFNSKYWIFYSNQAEDKKLLLYDFNGQHLIFIKQQFYGQLNLLLSDAIICMDCNFGYNSNTIQILVGFQNGKLLKLNCDLNGNVNNHLLLKDPSTSSHQSHLSILNVWAGLLPHFVVSFSLKDGLLITSLDHQQSNGSFQSFHTNIDLPVDLRTTTNVKSVLNFPQFTLYKGNDMIFHCKNLLGSDASTLNKEINFMLKIDEDVQKIDYLLKTNHILLETNMRYLSIPTRDPIENSNSSPPVSDSEVYPIFYKTQELHVHASGTGRQIANNGKYIFITEQHLYGTALSVYKYSISFKRWLFVGYSDIRAKYGIRSVKDLFVGNCPSVNSPVLTILTDDNNIQTILLK

SEQ ID NO: 791 - protein, 494 aa, Saccharomyces cerevisiae
  misc_feature (0)...(0): Polypeptide Accession Number YPL204W
MDLRVGRKFRIGRKIGSGSFGDIYHGTNLISGEEVAIKLESIRSRHPQLDYESRVYRYLSGGVGIPFIRWFGREGEYNAMVIDLLGPSLEDLFNYCHRRFSFKTVIMLALQMFCRIQYIHGRSFIHRDIKPDNFLMGVGRRGSTVHVIDFGLSKKYRDFNTHRHIPYRENKSLTGTARYASVNTHLGIEQSRRDDLESLGYVLIYFCKGSLPWQGLKATTKKQKYDRIMEKKLNVSVETLCSGLPLEFQEYMAYCKNLKFDEKPDYLFLARLFKDLSIKLEYHNDHLFDWTMLRYTKAMVEKQRDLLIEKGDLNANSNAASASNSTDNKSETFNKIKLLAMKKFPTHFHYYKNEDKHNPSPEEIKQQTILNNNAASSLPEELLNALDKGMENLRQQQPQQQVQSSQPQPQPQQLQQQPNGQRPNYYPEPLLQQQQRDSQEQQQQVPMATTRATQYPPQINSNNFNTNQASVPPQMRSNPQQPPQDKPAGQSIWL

SEQ ID NO: 792 - protein, 181 aa, Saccharomyces cerevisiae
  misc_feature (0)...(0): Polypeptide Accession Number YPL211W
MRQLTEEETKVVFEKLAGYIGRNISFLVDNKELPHVFRLQKDRVYYVPDHVAKLATSVARPNLMSLGICLGKFTKTGKFRLHITSLTVLAKHAKYKIWIKPNGEMPFLYGNHVLKAHVGKMSDDIPEHAGVIVFAMNDVPLGFGVSAKSTSESRNMQPTGIVAFRQADIGEYLRDEDTLFT

SEQ ID NO: 793 - protein, 540 aa, Saccharomyces cerevisiae
  misc_feature (0)...(0): Polypeptide Accession Number YPL214C
MVFTKEEVDYSLYLVTDSTMLPPGTTLCSQVEAGLKNGVTLVQIREKDIETKNFVAEALEVQKICKKYNVPLIINDRIDVAMAIDADGVHVGQDDMPIPMVRKLLGPSKILGWSVGKPSEVETLAKWGPDMVDYIGVGTLFPTSTKKNPKKSPMGPQGAIAILDALEEFKATWCRTVGIGGLHPDNIQRVLCQCVASNGKRSLDGISLVSDIMAAPDACAATKRLRGLLDATRYQFVECELNNTFPTTTSIQNVISQVSNNRPLVQHITNKVHQNFGANVTLALGSSPIMSEIESEVSELARIPNASLLLNTGSVAPIEMLKAAINAYNEVNRPITFDPVGYSATETRLCLNNTLLTYGQFACIKGNCSEILSLAKLNNHKMKGVDSSSGKTNIDTLVRATQIVAFQYRTVAVCTGEFDCVADGTFGGEYKLSSGTEGITAEDLPCVIIEDGPIPIMGDITASGCSLGSTIASFIGGLDSTGKLFDAVVGAVLLYKSAGKLASTRCQGSGSFHVELIDALYQLFHENKPEKWSASLKKFK

SEQ ID NO: 794 - protein, 688 aa, Saccharomyces cerevisiae
  misc_feature (0)...(0): Polypeptide Accession Number YPL222W
MGEKRTIIKALKNSAASHFIKKLTADTSLSSIQEAINVVQQYNATDPVRLKLFHTPRMVSQGAHFAFCLPTKKPHYKPLLLSQNALDEFNLVQDQDLEKILSGEKVYYSDSIFPYSTVYSGFQFGSFAAQLGDGRVVNLFDLKDKCSGQWQTFQLKGAGMTPFSRFADGKAVLRSSIREFIMSEALHSIGIPSTRAMQLTLLPGTKAQRRNQEPCAVVCRFAPSWIRLGNFNLFRWRHDLKGLIQLSDYCIEELFAGGTQFEGKPDFNIFKRDFFPDTETKIDEQVEKDETEVSTMTGDNISTLSKYDEFFRHVVSLNANTVAHWQAYGFANGVLNTDNTSIMGLTIDYGPFAFLDKFEPSFTPNHDDTAKRYSFANQPSIIWWNLQQFAKDLACLLGPEARDLELLLKGELNSVDDALEKTMIERVQKLVELSANEYKYVFTTRYAQIMSQRLGVDLDLEKCMSSTNLKDIEHAAEKAKEFCDVIVEPLLDILQATKVDYNNFFIHLQNYKGPFFIKDKSDTATLFGAFDEEYLGMFFNSKQLQQMAETEEAFAAGEKVFDANGELRLLNEKLQEIRNWTQDYLTLVPPTETAARASLAKKANPLFVPRSWVLEEVVDDLMYSQRDGLQDPSSELDTSALKKLYLMSVNPYDRTKWDVTLRPELETKWADLSHQDDAKFMMQASCSS

SEQ ID NO: 795 - protein, 206 aa, Saccharomyces cerevisiae
  misc_feature (0)...(0): Polypeptide Accession Number YPL229W
MMPYNTPPNIQEPMNFASSNPFGIIPDALSFQNFKYDRLQQQQQQQQQQQQNRTASSLQQPQQQQPISPPLFLVGAGTSENSNLNKNANTSTIPPLLFSRSSQHYVVPDIDHSSIIYKNNICKSFKDDLFFCPRSLLSLEEQQACEKMDRLTAEQMSLYHQNTQSSSNPGSMSSSPPNSASSIFNSRPKFNPYTSQSFNPLESVQE

SEQ ID NO: 796 - protein, 475 aa, Saccharomyces cerevisiae
  misc_feature (0)...(0): Polypeptide Accession Number YPL259C
MASAVYFCDHNGKPLLSRRYRDDIPLSAIDKFPILLSDLEEQSNLIPPCLNHNGLEYLFIQHNDLYVVAIVTSLSANAAAIFTFLHKLVEVLSDYLKTVEEESIRDNFVIIYELLDEVMDYGIPQITETKMLKQYITQKSFKLVKSAKKKRNATRPPVALTNSVSWRPEGITHKKNEAFLDIVESINMLMTQKGQVLRSEIIGDVKVNSKLSGMPDLKLGINDKGIFSKYLDDDTNIPSASATTSDNNTETDKKPSITSSSATNKKKVNIELEDLKFHQCVRLSKFENEKIITFIPPDGKFDLMNYRLSTTIKPLIWCDVNVQVHSNSRIEIHCKAKAQIKRKSTATNVEILIPVPDDADTPTFKYSHGSLKYVPEKSAILWKIRSFPGGKEYSMSAELGLPSISNNEDGNRTMPKSNAEILKGPVQIKFQIPYFTTSGIQVRYLKINEPKLQYKSYPWVRYITQSGDDYTIRLT

SEQ ID NO: 797 - protein, 551 aa, Saccharomyces cerevisiae
  misc_feature (0)...(0): Polypeptide Accession Number YPL260W
MFASAGQQHPQIVPKEEESILNYLLEVRSSLAKLKQNRTQYLNSKDVQTTYQHVLTKVRELDDIRKNSHETPAKSAATLIHSTELHNRVDSVLDDVFQLLSLCFLTVGLKNSAPATYASLSTVESLLEHLNESNVFTHHDLSPIKERLEEISKIVEQKNSSPAYDEDGNDDRLREIDNERKKNKIEEDLLLRAKLKHCKDEYDILEGKLEEIDPSLSTVMEKLFRIRRGLLSLVASAKKTMSKSDINTNSLLQEQNDLQTNNESLTDDKHLVSQEYVHEKLSVLKNELSELESNRDDSGKFKSLESHQVAEKGQSVLNGLLDDCHDLVNDLSHQKNGGLTLDPYLQPIYEQLIDIKTTLENLMITRRWTLRETDLFSYQKKLNEIDNKRINGKFPTKSQDSKGQSILLYLLRRCYAIIYKLLESSEPVSEALQPIHNQLSTVRRCLLELKRMGGVNNERELYPYQMKLASLDNLRTEGIFYDSDGNIPEGQGILNALLAECFDILHELKVEAEEKAQNSTSSDGSDDDDNGESGIDSNSNDSEPESEYQQE

SEQ ID NO: 798 - protein, 606 aa, Saccharomyces cerevisiae
  misc_feature (0)...(0): Polypeptide Accession Number YPR018W
MEQHLKSIPLQDDTKKKGILSFFQNTTTVKSNKFLTKEKDVITLDDPKEDVSGPMIETVKQETMKSINKECADEMKTTPKKANAEDKLLCYKNSPIQSTKYDRNTNKQVPNGNIIAIETKSRSSSPCSKRELSSSKKEEAKREKELKKQQRAEEKHRKELLRQEEKKKKELKVEEERQRRAELKKQKEEEKRRKEEARLEAKRRKEEERLKKEEEIRLKEEAKERAQSRIGNFFKKLSDSNTPVVEKSDYEKFFLPFYAKDGVRVSNKWKLTKVELEGSKRKIDDELLNSKDKTSSDDLLNWLQSRRLPRGHKIKRKAVDVLQQMPLKEKTDDELQSLLAQVPHKYIKFYENVRPPFIGTYSMDFTLPPNDPFSTKGTGFNYDYDSDVEWVNEEEEGEVDNLESGEEEEEEEDDEDVPSEGEFDGFLDSEENSDLDGLPCAKRKFVGPLIPTICLKSNFENLSEENKRYLQQLKAEVIIETDGPIDPFKEPKTSSLPSKRSNSDLQAQTASQSQSPEKKQKAMITDPMDLLRLFDGVQDSTFSLGTVTEIAQKNLPQYNKQTIKNTIKEYAIRSSGKGDLPRKWVIKDAQNWENLRANANMPTPSL

SEQ ID NO: 799 - protein, 115 aa, Saccharomyces cerevisiae
  misc_feature (0)...(0): Polypeptide Accession Number YPR020W
MLSRIQNYTSGLVSKANLLSSKALYYGKVGAEISKQIYLKEGLQPPTVAQFKSVYSNLYKQSLNFALKPTEVLSCLKNIQKNELLKYGAYGIQLIGFYSVGEIIGRRKLVGYKHH

SEQ ID NO: 800 - protein, 356 aa, Saccharomyces cerevisiae
  misc_feature (0)...(0): Polypeptide Accession Number YPR040W
MSKRNTPPLRSSGINTIQINAAREMHAQTVRARRMPMPTSGITTPSVQPTAAPATPPRHICNNPNNPQCLHCGSVIIPSPRATLPLEDNPSISINDWTISSRKKPILNSQELDIWENEKLKGLTLPEMIFGNNYIRIENSKQHWSIEFNALDALKEVQLQDSGIRVAYSNDWINSKKRQNSTNGAQRFTNDVNDDSLNIIHKYDWTYTTRYKGTESSPESKFRLDNDQKLPLDKLAVHDKILFYDDMILFEDELADNGISILNVKIRVMNERLLLLSRFFLRVDDVLVRVYDTRIYVEFDENVVIRESKEFEGKYQDVLAKHRLSQSHDPKAALRDSNWVAQNTPMIKRQCEIIQF

SEQ ID NO: 801 - protein, 181 aa, Saccharomyces cerevisiae
  misc_feature (0)...(0): Polypeptide Accession Number YPR046W
MTNSSEKQWERIQQLEKEHVEVYRELLITLDRLYLIRKHNHAVILSHTQQRLLEIRHQLQINLEKTALLIRLLEKPDNTNVLFTKLQNLLEESNSLDYELLQSLGAQSSLHKQLIESRAERDELMSKLIELSSKFPKPTIPPDDSDTAGKQVEVEKENETIQELMIALQIHSGYTNISYTI

SEQ ID NO: 802 - protein, 623 aa, Saccharomyces cerevisiae
  misc_feature (0)...(0): Polypeptide Accession Number YPR048W
MSSSKKIVILYGSETGNAHDFATILSHRLHRWHFSHTFCSIGDYDPQDILKCRYLFIICSTTGQGELPRNVNALKGERPVTFWSFLKRKNLPSNLLNHIQTAMLGLGDSSYPKFNYGIRKLHQRIVTQLGANELFDRLEADDQAMAGSNKGTGLGIESVYFEYEKKVLSFLLSKYPNRKVNGQIIKREELDPEVYLEPASYLQLSDEHANEKFTSTKVIFEGDESLKVGRVNINKRITSEGHFQDVRQFKFSNVDKIQENYEPGDTVTIYPCNTDEDVSRFLANQSHWLEIADKPLNFTSGVPNDLKDGGLVRPMTLRNLLKYHCDFMSIPRTSFFLKIWTFATDVTKMERGQEQLNDQREKLRQFATDQDMQDLYDYCNRPRRSILEVLEDFISVKLPWKYVLDYLPIIKPRYYSISSGPGDPNIELTVAIVKYKTILRKIRRGICTNYIARLQEGEQIRYKLQNNHIIKKEFLNKPMILVGPGVGLAPLLSVVKAEISKDIKLLFGCRYKDKDYIYKDMLEDWFRKGKIALHSSFSRDEENSPGVKYVQDYLWRLGEEITNLVVNKDAVFFLCGSSGKMPIQVRLTFIEMLKKWGNFSDEETAKKYLKEMEKSDRYIQETW

SEQ ID NO: 803 - protein, 176 aa, Saccharomyces cerevisiae
  misc_feature (0)...(0): Polypeptide Accession Number YPR051W
MEIVYKPLDIRNEEQFASIKKLIDADLSEPYSIYVYRYFLNQWPELTYIAVDNKSGTPNIPIGCIVCKMDPHRNVRLRGYIGMLAVESTYRGHGIAKKLVEIAIDKMQREHCDEIMLETEVENSAALNLYEGMGFIRMKRMFRYYLNEGDAFKLILPLTEKSCTRSTFLMHGRLAT

SEQ ID NO: 804 - protein, 388 aa, Saccharomyces cerevisiae
  misc_feature (0)...(0): Polypeptide Accession Number YPR054W
MNCTLTDNTRAINVASNLGAPQQRTIFAKERISIPGYYEIIQFLGKGAYGTVCSVKFKGRSPAARIAVKKISNIFNKEILLKRAIRELKFMNFFKGHKNIVNLIDLEIVTSSPYDGLYCYQELIDYDLAKVIHSSVQLSEFHIKYFLYQILCGLKYIHSADVIHRDLKPGNILCTLNGCLKICDFGLARGIHAGFFKCHSTVQPHITNYVATRWYRAPELLLSNQPYSKSVDIWAVGCILAEFYARKPVFMGRDSMHQIFEIIKVLGTPDKDILIKFGTIKAWNLGKNSNNPVYKKIPWSNIFPFASHEAINLIESLLHWDSTHRLNVEQAISHPFLNEVRKPDDEPVCLQGPFDFTYESELNSMSKLRDYLVEEVKNFKTDLSSSSL

SEQ ID NO: 805 - protein, 158 aa, Saccharomyces cerevisiae
  misc_feature (0)...(0): Polypeptide Accession Number YPR062W
MVTGGMASKWDQKGMDIAYEEAALGYKEGGVPIGGCLINNKDGSVLGRGHNMRFQKGSATLHGEISTLENCGRLEGKVYKDTTLYTTLSPCDMCTGAIIMYGIPRCVVGENVNFKSKGEKYLQTRGHEVVVVDDERCKKIMKQFIDERPQDWFEDIGE

SEQ ID NO: 806 - protein, 299 aa, Saccharomyces cerevisiae
  misc_feature (0)...(0): Polypeptide Accession Number YPR066W
MDCKILVLGAGGLGCEILKNLTMLSFVKQVHIVDIDTIELTNLNRQFLFCDKDIGKPKAQVAAQYVNTRFPQLEVVAHVQDLTTLPPSFYKDFQFIISGLDAIEPRRFINETLVKLTLESNYEICIPFIDGGTEGLKGHVKTIIPGITACWECSIDTLPSQQDTVPMCTIANNPRCIEHVVEYVSTIQYPDLNIESTADMEFLLEKCCERAAQFSISTEKLSTSFILGIIKSIIPSVSTTNAMVAATCCTQMVKIYNDLIDLENGNNFTLINCSEGCFMYSFKFERLPDCTVCSNSNSN

SEQ ID NO: 807 - protein, 566 aa, Saccharomyces cerevisiae
  misc_feature (0)...(0): Polypeptide Accession Number YPR070W
MVEGDSYVETLDSMIELFKDYKPGSITLENITRLCQTLGLESFTEELSNELSRLSTASKIIVIDVDYNKKQDRIQDVKLVLASNFDNFDYFNQRDGEHEKSNILLNSLTKYPDLKAFHNNLKFLYLLDAYSHIESDSTSHNNGSSDKSLDSSNASFNNQGKLDLFKYFTELSHYIRQCFQDNCCDFKVRTNLNDKFGIYILTQGINGKEVPLAKIYLEENKSDSQYRFYEYIYSQETKSWINESAENFSNGISLVMEIVANAKESNYTDLIWFPEDFISPELIIDKVTCSSNSSSSPPIIDLFSNNNYNSRIQLMNDFTTKLINIKKFDISNDNLDLISEILKWVQWSRIVLQNVFKLVSTPSSNSNSSELEPDYQAPFSTSTKDKNSSTSNTEPIPRSNRHGSVVEASRRRRSSTNKSKRPSITEAMMLKEEGLQQFNLHEILSEPAIEEENGDSIKEHSTTMDGANDLGFTASVSNQENAGTDIVMEDHGVLQGTSQNYGTATADDADIEMKDVSSKPSKPESSVLQLIVSEDHIILDTISECNLYDDVKCWSKFIEKFQDIVS

SEQ ID NO: 808 - protein, 143 aa, Saccharomyces cerevisiae
  misc_feature (0)...(0): Polypeptide Accession Number YPR082C
MASVLLPQLRTGWHVDQAIVTETKRLVVIRFGRKNDRQCMIMDELLSSIAERVRNFAVIYLCDIDEVSDFDEMYELTDPMTVMFFYHNKHMMCDFGTGNNNKLNFIVDDKQEMIDILETIFRGARKNKGLVVSPYDYNHKRVS

SEQ ID NO: 809 - protein, 861 aa, Saccharomyces cerevisiae
  misc_feature (0)...(0): Polypeptide Accession Number YPR105C
MEGQKSNASWESSIIEGQLSKNLARYTLLLDKLSTLSQIDKLSEVIANDYAKQSKQLNAFVQQSQSSLNKESRKLELQRTNLTTTLTQFHETVATISSSNARAKAIHDDIETVDQERALVNKTLQFVKDVRTLKNNISLAHSALETKDYLVAATAINEIRSLPDKKLIVSEFAKKVVPSSEIPEEPAILIKNWCKELTSLFQEQFMEATRTQDIKELTLMFKMFPMIGQDVLGLDLYSKYVCDIIADESRKIMSNSMENSTKFQGFFSQVLLHLFKIVSTIINDHSKVIATCYGKKHMVHVMEKVEKEADLQASLILDIFMETRKIERTIHDINEWEHSQKNEDVNIDSNQSDIETDGETEKSSIISIHDLALLIMEFSQILQNWSMYSRFYSVKWNEFSDLHPHVLQPPPPIADGKFALKLKQDKVFDEFQVFVLNHLQRSFRNSISLEELPSLNDLITAVPLNDHDNISYPVTSVLDDLILLVRKNLISVVNTGQFKLLASFLNELVKFFQNRFLVKFMQNKFKLLQSKLASNVSLKRYIPKGEEQSATSRSVSPPANKFSPLSRFTFRGAAASALTNIQSNLQAVVAEDEDSILALHHYLIYLNTLYLSKVYVHRLLSIEILEDDSQRILRDNFPFDNDAAQLQNLIINSEKLVLEQTDKLSKWAVKYLFQNILQNRVRNLLGTVFVNSASSNSSTSNQKNVSRDYSAGSNQKNYITSIEDFEDLSQINSFNSKWNQLIIPYKNILHNEAYAELLSVIVDYIVTTLEQRIWTLEFNELGVTKLDRELSLFIGNMCGLNYNLREKFLKLTQIVLLLGLDDDNFDLTTGDIKDDFNGTFDWVINSQERIKARNMKIDRTQ

SEQ ID NO: 810 - protein, 208 aa, Saccharomyces cerevisiae
  misc_feature (0)...(0): Polypeptide Accession Number YPR107C
MSLIHPDTAKYPFKFEPFLRQEYSFSLDPDRPICEFYNSREGPKSCPRGPLCPKKHVLPIFQNKIVCRHWLRGLCKKNDQCEYLHEYNLRKMPECVFFSKNGYCTQSPDCQYLHIDPASKIPKCENYEMGFCPLGSSCPRRHIKKVFCQRYMTGFCPLGKDECDMEHPQFIIPDEGSKLRIKRDDEINTRKMDEEKERRLNAIINGEV

SEQ ID NO: 811 - protein, 335 aa, Saccharomyces cerevisiae
  misc_feature (0)...(0): Polypeptide Accession Number YPR110C
MSNIVGIEYNRVTNTTSTDFPGFSKDAENEWNVEKFKKDFEVNISSLDAREANFDLINIDTSIANAFRRIMISEVPSVAAEYVYFFNNTSVIQDEVLAHRIGLVPLKVDPDMLTWVDSNLPDDEKFTDENTIVLSLNVKCTRNPDAPKGSTDPKELYNNAHVYARDLKFEPQGRQSTTFADCPVVPADPDILLAKLRPGQEISLKAHCILGIGGDHAKFSPVSTASYRLLPQINILQPIKGESARRFQKCFPPGVIGIDEGSDEAYVKDARKDTVSREVLRYEEFADKVKLGRVRNHFIFNVESAGAMTPEEIFFKSVRILKNKAEYLKNCPITQ

SEQ ID NO: 812 - protein, 1083 aa, Saccharomyces cerevisiae
  misc_feature (0)...(0): Polypeptide Accession Number YPR115W
MSDYFTFPKQENGGISKQPATPGSTRSSSRNLELPKNYRSFGGSSDELASMYSADSQYLMDMIPDSLTLKNEPASGNTQMNGPDGKENKDIKLDEYILPKTDPRSPYYINMPIPKKLPKSEGKARAKQKVNRADPSDLDVENIYETSGEFVREYPTDILIDRFHKWKKILKSLIAYFREAAYSQEQIARINYQMKNAVKFAFLTDLEDETNKLVDPSISKLPTKKPQPVPLAAQKLDSKYDTDVEQPQSIQSVPSEEVASASSGFMKFGSGSIQDIQVILKKYHLSLGSQQYKISKEILAYIIPKLTDLRKDLTTKMKEIKELNGDFKTNIGEHIKITSRLLNKYIASVKLLDEASTSGDKQGEKLKPKHDPYLLKLQLDLQLKRQLLEENYLREAFLNLQSAALQLEKIVYSKIQSALQRYSALIDSEARLMIKNLCHELQQGILSRPPAVEWDNFVSHHPTCLMNLKSTDPPPQPRRLSDIVYPNMKSPLAKCIRVGYLLKKTESSKSFTKGYFVLTTNYLHEFKSSDFFLDSKSPRSKNKPVVEQSDISRVNKDGTNAGSHPSSKGTQDPKLTKRRKGLSSSNLYPISSLSLNDCSLKDSTDSTFVLQGYASYHSPEDTCTKESSTTSDLACPTKTLASNKGKHQRTPSALSMVSVPKFLKSSSVPKEQKKAKEEANINKKSICEKRVEWTFKIFSASLEPTPEESKNFKKWVQDIKALTSFNSTQERSNFIEEKILKSRNHNNGKSSQRSKNSTYITPVDSFVNLSEKVTPSSSVTTLNTRKRANRPRYIDIPKSANMNAGAMNSVYRSKVNTPAIDENGNLAIVGETKNSAPQNGMSYTIRTPCKSPYSPYTGEGMLYNRSADNLMASSSRKASAPGEVPQIAVSNHGDEAIIPASAYSDSSHKSSRASSVASIHNQRVDFYPSPLMNLPGVSPSCLALDGNANGYFGIPLNCNSEARRGSDLSPFEMESPLFEENRTQNCSGSRKSSACHIPHQCGPRKEGNDSRLIYGNEKGASQSRLTLKEPLTSKGVEAPYSSLKKTYSAENVPLTSTVSNDKSLHSRKEGSTNTVPATSASSK

SEQ ID NO: 813 - protein, 491 aa, Saccharomyces cerevisiae
  misc_feature (0)...(0): Polypeptide Accession Number YPR119W
MSNPIENTENSQNTSSSRFLRNVQRLALNNVTNTTFQKSNANNPALTNFKSTLNSVKKEGSRIPQFTRESVSRSTAAQEEKRTLKENGIQLPKNNLLDDKENQDPSSQQFGALTSIKEGRAELPANISLQESSSAKEIIQHDPLKGVGSSTEVVHNSVENEKLHPARSQLQVRNTESETDSGKKRPISTIVEQELPKKFKVCDENGKEEYEWEDLDAEDVNDPFMVSEYVNDIFEYLHQLEVITLPKKEDLYQHRNIHQNRDILVNWLVKIHNKFGLLPETLYLAINIMDRFLGKELVQLDKLQLVGTSCLFIASKYEEVYSPSIKHFASETDGACTEDEIKEGEKFILKTLKFNLNYPNPMNFLRRISKADDYDIQSRTLAKFLLEISLVDFRFIGILPSLCAAAAMFMSRKMLGKGKWDGNLIHYSGGYTKEELAPVCHMIMDYLVSPIVHDEFHRKYQSRRFMKASIISVQWALKVRKNGYDIMTLHE

SEQ ID NO: 814 - protein, 465 aa, Saccharomyces cerevisiae
  misc_feature (0)...(0): Polypeptide Accession Number YPR152C
MRGEWQEFKTPAGKKYYYNKNTKQSRWEKPNLKKGSNLESNAKESQTERKPTFSLELVNGWHLIIYNDGTKLYFNDDSKEFKNDISQEDDSRCRSLIESLDKEKLVLLIGVARGYTMREEDIDKILESCNEEIHLFKRNQDEVERKDEISEEAGDVKSPLQESHTGLVSGYGSSSGEEDEEEDEEEDEENEEQIVNQDISIIDDLNRIDTDDIDERNIFFELFDRYKLDKFSTWSLQSKKIENDPDFYKIRDDTVRESLFEEWCGERSGNATAEESDSEDNSEDDSEVLEPTKYHYLAQIVANAGTIAPDTIPQDIRKQQKALYKAYKIKEYIPSKRDQDKFVSQLLFYYKTFDLEQRKEIFCDCLRDHERDFTGAVESLRQDKELIDRWQTLLKAPADSSSIEDILLSIEHRCCVSPIVVTEPRYYVVGILEKTVVWVRWLAAEVGPSSRFTPVGAGNEPINPE

SEQ ID NO: 815 - protein, 720 aa, Saccharomyces cerevisiae
  misc_feature (0)...(0): Polypeptide Accession Number YPR159W
MPLRNLTETHNFSSTNLDTDGTGDDHDGAPLSSSPSFGQQNDNSTNDNAGLTNPFMGSDEESNARDGESLSSSVHYQPQGSDSSLLHDNSRLDLSQNKGVSDYKGYYSRNNSRAVSTANDNSFLQPPHRAIASSPSLNSNLSKNDILSPPEFDRYPLVGSRVTSMTQLNHHGRSPTSSPGNESSASFSSNPFLGEQDFSPFGGYPASSFPLMIDEKEEDDYLHNPDPEEEARLDRRRFIDDFKYMDKRSASGLAGVLLLFLAAIFIFIVLPALTFTGAIDHESNTEEVTYLTQYQYPQLSAIRTSLVDPDTPDTAKTREAMDGSKWELVFSDEFNAEGRTFYDGDDPYWTAPDVHYDATKDLEWYSPDASTTVNGTLQLRMDAFKNHGLYYRSGMLQSWNKVCFTQGALEISANLPNYGRVSGLWPGLWTMGNLGRPGYLASTQGVWPYSYESCDAGITPNQSSPDGISYLPGQKLSICTCDGEDHPNQGVGRGAPEIDVLEGETDTKIGVGIASQSLQIAPFDIWYMPDYDFIEVYNFTTTTMNTYAGGPFQQAVSAVSTLNVTWYEFGEYGGYFQKYAIEYLNDDDNGYIRWFVGDTPTYTIHAKALHPDGNIGWRRISKEPMSIILNLGISNNWAYIDWQYIFFPVVMSIDYVRIYQPSNAISVTCDPSDYPTYDYIQSHLNAFQNANLTTWEDAGYTFPKNILTGKCTSSKFKLSS

SEQ ID NO: 816 - protein, 437 aa, Saccharomyces cerevisiae
  misc_feature (0)...(0): Polypeptide Accession Number YPR173C
MSTGDFLTKGIELVQKAIDLDTATQYEEAYTAYYNGLDYLMLALKYEKNPKSKDLIRAKFTEYLNRAEQLKKHLESEEANAAKKSPSAGSGSNGGNKKISQEEGEDNGGEDNKKLRGALSSAILSEKPNVKWEDVAGLEGAKEALKEAVILPVKFPHLFKGNRKPTSGILLYGPPGTGKSYLAKAVATEANSTFFSVSSSDLVSKWMGESEKLVKQLFAMARENKPSIIFIDEVDALTGTRGEGESEASRRIKTELLVQMNGVGNDSQGVLVLGATNIPWQLDSAIRRRFERRIYIPLPDLAARTTMFEINVGDTPCVLTKEDYRTLGAMTEGYSGSDIAVVVKDALMQPIRKIQSATHFKDVSTEDDETRKLTPCSPGDDGAIEMSWTDIEADELKEPDLTIKDFLKAIKSTRPTVNEDDLLKQEQFTRDFGQEGN

SEQ ID NO: 817 - protein, 86 aa, Saccharomyces cerevisiae
  misc_feature (0)...(0): Polypeptide Accession Number YPR182W
MSESSDISAMQPVNPKPFLKGLVNHRVGVKLKFNSTEYRGTLVSTDNYFNLQLNEAEEFVAGVSHGTLGEIFIRCNNVLYIRELPN

SEQ ID NO: 818 - protein, 738 aa, Saccharomyces cerevisiae
  misc_feature (0)...(0): Polypeptide Accession Number YPR185W
MVAEEDIEKQVLQLIDSFFLKTTLLICSTESSRYQSSTENIFLFDDTWFEDHSELVSELPEIISKWSHYDGRKELPPLVVETYLDLRQLNSSHLVRLKDHEGHLWNVCKGTKKQEIVMERWLIELDNSSPTFKSYSEDETDVNELSKQLVLLFRYLLTLIQLLPTTELYQLLIKSYNGPQNEGSSNPITSTGPLVSIRTCVLDGSKPILSKGRIGLSKPIINTYSNALNESNLPAHLDQKKITPVWTKFGLLRVSVSYRRDWKFEINNTNDELFSARHASVSHNSQGPQNQPEQEGQSDQDIGKRQPQFQQQQQPQQQQQQQQQQQRQHQVQTQQQRQIPDRRSLSLSPCTRANSFEPQSWQKKVYPISRPVQPFKVGSIGSQSASRNPSNSSFFNQPPVHRPSMSSNYGPQMNIEGTSVGSTSKYSSSFGNIRRHSSVKTTENAEKVSKAVKSPLQPQESQEDLMDFVKLLEEKPDLTIKKTSGNNPPNINISDSLIRYQNLKPSNDLLSEDLSVSLSMDPNHTYHRGRSDSHSPLPSISPSMHYGSLNSRMSQGANASHLIARGGGNSSTSALNSRRNSLDKSSNKQGMSGLPPIFGGESTSYHHDNKIQKYNQLGVEEDDDDENDRLLNQMGNSATKFKSSISPRSIDSISSSFIKSRIPIRQPYHYSQPTTAPFQAQAKFHKPANKLIDNGNRSNSNNNNHNGNDAVGVMHNDEDDQDDDLVFFMSDMNLSKEG

SEQ ID NO: 819 - protein, 521 aa, Homo sapiens [sequence omitted]

SEQ ID NO: 820 - protein, 2555 aa, Homo sapiens
  misc_feature (0)...(0): Polypeptide Accession Number O00507
MTAITHGSPVGGNDSQGQVLDGQSQHLFQQNQTSSPDSSNENSVATPPPEEQGQGDAPPQHEDEEPAFPHTELANLDDMINRPRWVVPVLPKGELEVLLEAAIDLSVKGLDVKSEACQRFFRDGLTISFTKILMDEAVSGWKFEIHRCIINNTHRLVELCVAKLSQDWFPLLELLAMALNPHCKFHIYNGTRPCELISSNAQLPEEELFARSSDPRSPKGWLVDLINKFGTLNGFQILHDRFFNGSALNIQIIAALIKPFGQCYEFLSQHTLKKYFIPVIEIVPHLLENLTDEELKKEAKNEAKNDALSMIIKSLKNLASRISGQDETIKNLEIFRLKMILRLLQISSFNGKMNALNEINKVISSVSYYTHRHSNPEEEEWLTAERMAEWIQQNNILSIVLQDSLHQPQYVEKLEKILRFVIKEKALTLQDLDNIWAAQAGKHEAIVKNVHDLLAKLAWDFSPGQLDHLFDCFKASWTNASKKQREKLLELIRRLAEDDKDGVMAHKVLNLLWNLAQSDDVPVDIMDLALSAHIKILDYSCSQDRDAQKIQWIDHFIEELRTNDKWVIPALKQIREICSLFGEASQNLSQTQRSPHIFYRHDLINQLQQNHALVTLVAENLATYMNSIRLYAGDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCRERKLIAKRRSYMMDDLELIGLDYLWRVVIQSSDEIANRAIDLLKEIYTNLGPRLKANQVVIHEDFIQSCFDRLKASYDTLCVFDGDKNSINCARQEAIRMVRVLTVIKEYINECDSDYHKERMILPMSRAFCGKHLSLIVRFPNQGRQVDELDIWFHTNDTIGSVRRCIVNRIKANVAHKKIELFVGGELIDSENDRKLIGQLNLKDKSLITAKLTQINFNMPSSPDSSSDSSTASPGNHRNHYNDGPNLKVESCLPGVIMSVHPKYISFLWQFANLGSNLNMPPLKNGARVLMKLMPPDRTAVEKLRTVCLDHANLGEGKLSPPLDSLFFGPSASQVLYLTEVVYALLMPAGVPLTDGSSDFQVHFLKSGGLPLVLSMLIRNNFLPNTDMETRRGAYLNALKIAKLLLTAIGYGHVRAVAEACQPVVDGTDPITQINQVTHDQAVVLQSALQSIPNPSSECVLRNESILLAQEISNEASRYMPDICVIRAIQKIIWASACGALGLFFSPNEEITKIYQMTTNGSNKLEVEDEQVCCEALEVMTLCFALLPTALDALSKEKAWQTFIIDLLLHCPSKTVRQLAQEQFFLMCTRCCMGHRPLLFFITLLFTILGSTAREKGKYSGDYFTLLRHLLNYAYNGNINIPNAEVLLVSEIDWLKRIRDNVKNTGETGVEEPILEGHLGVTKELLAFQTSEKKYHFGCEKGGANLIKELIDDFIFPASKVYLQYLRSGELPAEQAIPVCSSPVTINAGFELLVALAIGCVRNLKQIVDCLTEMYYMGTAITTCEALTEWEYLPPVGPRPPKGFVGLKNAGATCYMNSVIQQLYMIPSIRNSILAIEGTGSDLHDDMFGDEKQDSESNVDPRDDVFGYPHQFEDKPALSKTEDRKEYNIGVLRHLQVIFGHLAASQLQYYVPRGFWKQFRLWGEPVNLREQHDALEFFNSLVDSLDEALKALGHPAILSKVLGGSFADQKICQGCPHRFECEESFTTLNVDIRNHQNLLDSLEQYIKGDLLEGANAYHCEKCDKKVDTVKRLLIKKLPRVLAIQLKRFDYDWERECAIKFNDYFEFPRELDMGPYTVAGVANLERDNVNSENELIEQKEQSDNETAGGTKYRLVGVLVHSGQASGGHYYSYIIQRNGKDDQTDHWYKFDDGDVTECKMDDDEEMKNQCFGGEYMGEVFDHMMKRMSYRRQKRWWNAYIPFYEQMDMIDEDDEMIRYISELTIARPHQIIMSPAIERSVRKQNVKFMHNRLQYSLEYFQFVKKLLTCNGVYLNPAPGQDYLLPEAEEITMISIQLAARFLFTTGFHTKKIVRGPASDWYDALCVLLRHSKNVRFWFTHNVLFNVSNRFSEYLLECPSAEVRGAFAKLIVFIAHFSLQDGSCPSPFASPGPSSQACDNLSLSDHLLRATLNLLRREVSEHGHHLQQYFNLFVMYANLGVAEKTQLLKLNVPATFMLVSLDEGPGPPIKYQYAELGKLYSVVSQLIRCCNVSSTMQSSINGNPPLPNPFGDLNLSQPIMPIQQNVLDILFVRTSYVKKIIEDCSNSEDTIKLLRFCSWENPQFSSTVLSELLWQVAYSYTYELRPYLDLLFQILLIEDSWQTHRIHNALKGIPDDRDGLFDTIQRSKNHYQKRAYQCIKCMVALFSSCPVAYQILQGNGDLKRKWTWAVEWLGDELERRPYTGNPQYSYNNWSPPVQSNETANGYFLERSHSARMTLAKACELCPEEEPDDQDAPDEHEPSPSEDAPLYPHSPASQYQQNNHVHGQPYTGPAAHHLNNPQKTGQRTQENYEGNEEVSSPQMKDQ

SEQ ID NO: 821 - protein, 323 aa, Homo sapiens
  misc_feature (0)...(0): Polypeptide Accession Number O00628
MSAVCGGAARMLRTPGRHGYAAEFSPYLPGRLACATAQHYGIAGCGTLLILDPDEAGLRLFRSFDWNDGLFDVTWSENNEHVLITCSGDGSLQLWDTAKAAGPLQVYKEHAQEVYSVDWSQTRGEQLVVSGSWDQTVKLWDPTVGKSLCTFRGHESIIYSTIWSPHIPGCFASASGDQTLRIWDVKAAGVRIVIPAHQAEILSCDWCKYNENLLVTGAVDCSLRGWDLRNVRQPVFELLGHTYAIRRVKFSPFHASVLASCSYDFTVRFWNFSKPDSLLETVEHHTEFTCGLDFSLQSPTQVADCSWDETIKIYDPACLTIPA

SEQ ID NO: 822 - protein, 521 aa, Homo sapiens
  misc_feature (0)...(0): Polypeptide Accession Number O00629
MADNEKLDNQRLKNFKNKGRDLETMRRQRNEVVVELRKNKRDEHLLKRRNVPHEDICEDSDIDGDYRVQNTSLEAIVQNASSDNQGIQLSAVQAARKLLSSDRNPPIDDLIKSGILPILVHCLERDDNPSLQFEAAWALTNIASGTSEQTQAVVQSNAVPLFLRLLHSPHQNVCEQAVWALGNIIGDGPQCRDYVISLGVVKPLLSFISPSIPITFLRNVTWVMVNLCRHKDPPPPMETIQEILPALCVLIHHTDVNILVDTVWALSYLTDAGNEQIQMVIDSGIVPHLVPLLSHQEVKVQTAALRAVGNIVTGTDEQTQVVLNCDALSHFPALLTHPKEKINKEAVWFLSNITAGNQQQVQAVIDANLVPMIIHLLDKGDFGTQKEAAWAISNLTISGRKDQVAYLIQQNVIPPFCNLLTVKDAQVVQVVLDGLSNILKMAEDEAETIGNLIEECGGLEKIEQLQNHENEDIYKLAYEIIDQFFSSDDIDEDPSLVPEAIQGGTFGFNSSANVPTEGFQF

SEQ ID NO: 823 - protein, 187 aa, Homo sapiens
  misc_feature (0)...(0): Polypeptide Accession Number O00746
MGGLFWRSALRGLRCGPRAPGPSLLVRHGSGGPSWTRERTLVAVKPDGVQRRLVGDVIQRFERRGFTLVGMKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELVSWADGGQHSSIHPA

SEQ ID NO: 824 - protein, 1739 aa, Homo sapiens
  misc_feature (0)...(0): Polypeptide Accession Number O14647
MMRNKDKSQEEDSSLHSNASSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECLARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDRYAKGCETPGANLCQELFLGRK

SEQ ID NO: 825 - protein, 1194 aa, Homo sapiens
  misc_feature (0)...(0): Polypeptide Accession Number O14727
MDAKARNCLLQHREALEKDIKTSYIMDHMISDGFLTISEEEKVRNEPTQQQRAAMLIKMILKKDNDSYVSFYNALLHEGYKDLAALLHDGIPVVSSSSVRTVLCEGGVPQRPVVFVTRKKLVNAIQQKLSKLKGEPGWVTIHGMAGCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIFLWNTDSRSKVADCRGHLSWVHGVMFSPDGSSFLTSSDDQTIRLWETKKVCKNSAVMLKQEVDVVFQENEVMVLAVDHIRRLQLINGRTGQIDYLTEAQVSCCCLSPHLQYIAFGDENGAIEILELVNNRIFQSRFQHKKTVWHIQFTADEKTLISSSDDAEIQVWNWQLDKCIFLRGHQETVKDFRLLKNSRLLSWSFDGTVKVWNIITGNKEKDFVCHQGTVLSCDISHDATKFSSTSADKTAKIWSFDLLLPLHELRGHNGCVRCSAFSVDSTLLATGDDNGEIRIWNVSNGELLHLCAPLSEEGAATHGGWVTDLCFSPDGKMLISAGGYIKWWNVVTGESSQTFYTNGTNLKKIHVSPDFKTYVTVDNLGILYILQTLE

SEQ ID NO: 826 - protein, 901 aa, Homo sapiens
  misc_feature (0)...(0): Polypeptide Accession Number O15016
CELISCPGCERVYLTRDVTEHFFLHCVPTEQPKMARNCSECKEKRAAHILCTYCNRWLCSSCTEEHRHSPVPGGPFFPRAQKGSPGVNGGPGDFTLYCPLHTQEVLKLFCETCDMLTCHSCLVVEHKEHRCRHVEEVLQNQRMLLEGVTTQVAHKKSSLQTSAKQIEDRIFEVKHQHRKVENQIKMAKMVLMNELNKQANGLIEELEGITNERKRKLEQQLQSIMVLNRQFEHVQNFINWAVCSKTSVPFLFSKELIVFQMQRLLETSCNTDPGSPWSIRFTWEPNFWTKQLASLGCITTEGGQMSRADAPAYGGLQGSSPFYQSHQSPVAQQEALSHPSHKFQSPAVCSSSVCCSHCSPVSPSLKGQVPPPSIHPAHSFRQPPEMVPQQLGSLQCSALLPREKELACSPHPPKLLQPWLETQPPVEQESTSQRLGQQLTSQPVCIVPPQDVQQGAHAQPTLQTPSIQVQFGHHQKLKLSHFQQQPQQQLPPPPPPLPHPPPPLPPPPQQPHPPLPPSQHLASSQHESPPGPACSQNMDIMHHKFELEEMQKDLELLLQAQQPSLQLSQTKSPQHLQQTIVGQINYIVRQPAPVQSQSQEETLQATDEPPASQGSKPALPLDKNTAAALPQASGEETPLSVPPVDSTIQHSSPNVVRKHSTSLSIMGFSNTLEMELSSTRLERPLEPQIQSVSNLTAGAPQAVPSLLSAPPKMVSSLTSVQNQAMPSLTTSHLQTVPSLVHSTFQSMPNLISDSPQAMASLASDHPQAGPSLMSGHTQAVPSLATCPLQSIPPVSDMQPETGSSSSSGRTSGSLCPRDGADPSLENALCKVSPGEMLSKLPLFIIGQKIGHWDPYSDLSLTVLRPLMTTMSEFFDSCRHFTFERWKVRIPLASLTYWDKVP

SEQ ID NO: 827 - protein, 546 aa, Homo sapiens
  misc_feature (0)...(0): Polypeptide Accession Number O15355
MGAYLSQPNTVKCSGDGVGAPRLPLPYGFSAMQGWRVSMEDAHNCIPELDSETAMFSVYDGHGGEEVALYCAKYLPDIIKDQKAYKEGKLQKALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSKFFEDSEDESDEAEEEEEDSEECSEEEDGYSSEEAENEEDEDDTEEAEEDDEEEEEEMMVPGMEGKEEPGSDSGTTAVVALIRGKQLIVANAGDSRCVVSEAGKALDMSYDHKPEDEVELARIKNAGGKVTMDGRVNGGLNLSRAIGDHFYKRNKNLPPEEQMISALPDIKVLTLTDDHEFMVIACDGIWNVMSSQEVVDFIQSKISQRDENGELRLLSSIVEELLDQCLAPDTSGDGTGCDNMTCIIICFKPRNTAELQPESGKRKLEEVLSTEGAEENGNSDKKKKAKRD

SEQ ID NO: 828 - protein, 428 aa, Homo sapiens
  misc_feature (0)...(0): Polypeptide Accession Number O15379
MAKTVAYFYDPDVGNFHYGAGHPMKPHRLALTHSLVLHYGLYKKMIVFKPYQASQHDMCRFHSEDYIDFLQRVSPTNMQGFTKSLNAFNVGDDCPVFPGLFEFCSRYTGASLQGATQLNNKICDIAINWAGGLHHAKKFEASGFCYVNDIVIGILELLKYHPRVLYIDIDIHHGDGVQEAFYLTDRVMTVSFHKYGNYFFPGTGDMYEVGAESGRYYCLNVPLRDGIDDQSYKHLFQPVINQVVDFYQPTCIVLQCGADSLGCDRLGCFNLSIRGHGECVEYVKSFNIPLLVLGGGGYTVRNVARCWTYETSLLVEEAISEELPYSEYFEYFAPDFTLHPDVSTRIENQNSRQYLDQIRQTIFENLKMLNHAPSVQIHDVPADLLTYDRTDEADAEERGPEENYSRPEAPNEFYDGDHDNDKESDVEI

SEQ ID NO: 829 - protein, 343 aa, Homo sapiens
  misc_feature (0)...(0): Polypeptide Accession Number O15541
MAEQLSPGKAVDQVCTFLFKKPGRKGAAGRRKRPACDPEPGESGSSSDEGCTVVRPEKKRVTHNPMIQKTRDSGKQKAAYGDLSSEEEEENEPESLGVVYKSTRSAKPVGPEDMGATAVYELDTEKERDAQAIFERSQKIQEELRGKEDDKIYRGINNYQKYMKPKDTSMGNASSGMVRKGPIRAPEHLRATVRWDYQPDICKDYKETGFCGFGDSCKFLHDRSDYKHGWQIERELDEGRYGVYEDENYEVGSDDEEIPFKCFICRQSFQNPVVTKCRHYFCESCALQHFRTTPRCYVCDQQTNGVFNPAKELIAKLEKHRATGEGGASDLPEDPDEDAIPIT

SEQ ID NO: 830 - protein, 478 aa, Homo sapiens
  misc_feature (0)...(0): Polypeptide Accession Number O43236
MDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 831 - protein, 500 aa, Homo sapiens
  misc_feature (0)...(0): Polypeptide Accession Number P00352
SSSGTPDLPVLLTDLKIQYTKIFINNEWHDSVSGKKFPVFNPATEEELCQVEEGDKEDVDKAVKAARQAFQIGSPWRTMDASERGRLLYKLADLIERDRLLLATMESMNGGKLYSNAYLNDLAGCIKTLRYCAGWADKIQGRTIPIDGNFFTYTRHEPIGVCGQIIPWNFPLVMLIWKIGPALSCGNTVVVKPAEQTPLTALHVASLIKEAGFPPGVVNIVPGYGPTAGAAISSHMDIDKVAFTGSTEVGKLIKEAAGKSNLKRVTLELGGKSPCIVLADADLDNAVEFAHHGVFYHQGQCCIAASRIFVEESIYDEFVRRSVERAKKYILGNPLTPGVTQGPQIDKEQYDKILDLIESGKKEGAKLECGGGPWGNKGYFVQPTVFSNVTDEMRIAKEEIFGPVQQIMKFKSLDDVIKRANNTFYGLSAGVFTKDIDKAITISSALQAGTVWVNCYGVVSAQCPFGGFKMSGNGRELGEYGFHEYTEVKTVTVKISQKNS

SEQ ID NO: 832 - protein, 558 aa, Homo sapiens
  misc_feature (0)...(0): Polypeptide Accession Number P00367
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 833 - protein, 354 aa, Homo sapiens
  misc_feature (0)...(0): Polypeptide Accession Number P00480
MLFNLRILLNNAAFRNGHNFMVRNFRCGQPLQNKVQLKGRDLLTLKNFTGEEIKYMLWLSADLKFRIKQKGEYLPLLQGKSLGMIFEKRSTRTRLSTETGLALLGGHPCFLTTQDIHLGVNESLTDTARVLSSMADAVLARVYKQSDLDTLAKEASIPIINGLSDLYHPIQILADYLTLQEHYSSLKGLTLSWIGDGNNILHSIMMSAAKFGMHLQAATPKGYEPDASVTKLAEQYAKENGTKLLLTNDPLEAAHGGNVLITDTWISMGQEEEKKKRLQAFQGYQVTMKTAKVAASDWTFLHCLPRKPEEVDDEVFYSPRSLVFPEAENRKWTIMAVMVSLLTDYSPQLQKPKF

SEQ ID NO: 834 - protein, 1130 aa, Homo sapiens [sequence omitted]

SEQ ID NO: 835 - protein, 412 aa, Homo sapiens
  misc_feature (0)...(0): Polypeptide Accession Number P00966
MSSKGSVVLAYSGGLDTSCILVWLKEQGYDVIAYLANIGQKEDFEEARKKALKLGAKKVFIEDVSREFVEEFIWPAIQSSALYEDRYLLGTSLARPCIARKQVEIAQREGAKYVSHGATGKGNDQVRFELSCYSLAPQIKVIAPWRMPEFYNRFKGRNDLMEYAKQHGIPIPVTPKNPWSMDENLMHISYEAGILENPKNQAPPGLYTKTQDPAKAPNTPDILEIEFKKGVPVKVTNVKDGTTHQTSLELFMYLNEVAGKHGVGRIDIVENRFIGMKSRGIYETPAGTILYHAHLDIEAFTMDREVRKIKQGLGLKFAELVYTGLRPSPECEFVRHCIAKSQERVEGKVQVSVLKGQVYILGRESPLSLYNEELVSMNVQGDYEPTDATGFININSLRLKEYHRLQSKVTAK

SEQ ID NO: 836 - protein, 129 aa, Homo sapiens
  misc_feature (0)...(0): Polypeptide Accession Number P02261
SGRGKQGGKARAKAKTRSSRAGLQFPVGRVHRLLRKGNYAERVGAGAPVYLAAVLEYLTAEILELAGNAARDNKKTRIIPRHLQLAIRNDEELNKLLGKVTIAQGGVLPNIQAVLLPKKTESHHKAKGK

SEQ ID NO: 837 - protein, 471 aa, Homo sapiens
  misc_feature (0)...(0): Polypeptide Accession Number P02533
TTCSRQFTSSSSMKGSCGIGGGIGGGSSRISSVLAGGSCRAPSTYGGGLSVSSSRFSSGGAYGLGGGYGGGFSSSSSSFGSGFGGGYGGGLGAGLGGGFGGGFAGGDGLLVGSEKVTMQNLNDRLASYLDKVRALEEANADLEVKIRDWYQRQRPAEIKDYSPYFKTIEDLRNKILTATVDNANVLLQIDNARLAADDFRTKYETELNLRMSVEADINGLRRVLDELTLARADLEMQIESLKEELAYLKKNHEEEMNALRGQVGGDVNVEMDAAPGVDLSRILNEMRDQYEKMAEKNRKDAEEWFFTKTEELNREVATNSELVQSGKSEISELRRTMQNLEIELQSQLSMKASLENSLEETKGRYCMQLAQIQEMIGSVEEQLAQLRCEMEQQNQEYKILLDVKTRLEQEIATYRRLLEGEDAHLSSSQFSSGSQSSRDVTSSSRQIRTKVMDVHDGKVVSTHEQVLRTKN

SEQ ID NO: 838 - protein, 664 aa, Homo sapiens
  misc_feature (0)...(0): Polypeptide Accession Number P02545
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHGSHCSSSGDPAEYNLRSRTVLCGTCGQPADKASASGSGAQVGGPISSGSSASSVTVTRSYRSVGGSGGGSFGDNLVTRSYLLGNSSPRTQSPQNCSIM

SEQ ID NO: 839 - protein, 572 aa, Homo sapiens
  misc_feature (0)...(0): Polypeptide Accession Number P02546
METPSQRRATRSGAQASSTPLSPTRITRLQEKEDLQELNDRLAVYIDRVRSLETENAGLRLRITESEEVVSREVSGIKAAYEAELGDARKTLDSVAKERARLQLELSKVREEFKELKARNTKKEGDLIAAQARLKDLEALLNSKEAALSTALSEKRTLEGELHDLRGQVAKLEAALGEAKKQLQDEMLRRVDAENRLQTMKEELDFQKNIYSEELRETKRRHETRLVEIDNGKQREFESRLADALQELRAQHEDQVEQYKKELEKTYSAKLDNARQSAERNSNLVGAAHEELQQSRIRIDSLSAQLSQLQKQLAAKEAKLRDLEDSLARERDTSRRLLAEKEREMAEMRARMQQQLDEYQELLDIKLALDMEIHAYRKLLEGEEERLRLSPSPTSQRSRGRASSHSSQTQGGGSVTKKRKLESTESRSSFSQHARTSGRVAVEEVDEEGKFVRLRNKSNEDQSMGNWQIKRQNGDDPLLTYRFPPKFTLKAGQVVTIWAAGAGATHSPPTDLVWKAQNTWGCGNSLRTALINSTGEEVAMRKLVRSVTVVEDDEDEDGDDLLHHHHVSGSRR

SEQ ID NO: 840 - protein, 251 aa, Homo sapiens
  misc_feature (0)...(0): Polypeptide Accession Number P02812
GDNKSRSSRSPPGKPQGPPPQGGNQPQGPPPPPGKPQGPPPQGGNKPQGPPPPGKPQGPPPQGDNKSQSARSPPGKPQGPPPQGGNQPQGPPPPPGKPQGPPPQGDNKSQGPPPPGKPQGPPPQGGSKSRSSRSPPGKPQGPPPQGGNQPQGPPPPPGKPQGPPPQGGNKPQGPPPPGKPQGPPPQGGSKSRSARSPPGKPQGPPQQEGNNPQGPPPPAGGNPQQPQAPPAGQPQGPPRPPQGGRPSRPPQ

SEQ ID NO: 841 - protein, 536 aa, Homo sapiens
  misc_feature (0)...(0): Polypeptide Accession Number P04062
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKFLDAYAEHKLQFWAVTAENEPSAGLLSGYPFQCLGFTPEHQRDFIARDLGPTLANSTHHNVRLLMLDDQRLLLPHWAKVVLTDPEAAKYVHGIAVHWYLDFLAPAKATLGETHRLFPNTMLFASEACVGSKFWEQSVRLGSWDRGMQYSHSIITNLLYHVVGWTDWNLALNPEGGPNWVRNFVDSPIIVDITKDTFYKQPMFYHLGHFSKFIPEGSQRVGLVASQKNDLDAVALMHPDGSAVVVVLNRSSKDVPLTIKDPAVGFLETISPGYSIHTYLWHRQ

SEQ ID NO: 842 - protein, 4563 aa, Homo sapiens
  misc_feature (0)...(0): Polypeptide Accession Number P04114
MDPPRPALLALLALPALLLLLLAGARAEEEMLENVSLVCPKDATRFKHLRKYTYNYEAESSSGVPGTADSRSATRINCKVELEVPQLCSFILKTSQCTLKEVYGFNPEGKALLKKTKNSEEFAAAMSRYELKLAIPEGKQVFLYPEKDEPTYILNIKRGIISALLVPPETEEAKQVLFLDTVYGNCSTHFTVKTRKGNVATEISTERDLGQCDRFKPIRTGISPLALIKGMTRPLSTLISSSQSCQYTLDAKRKHVAEAICKEQHLFLPFSYNNKYGMVAQVTQTLKLEDTPKINSRFFGEGTKKMGLAFESTKSTSPPKQAEAVLKTLQELKKLTISEQNIQRANLFNKLVTELRGLSDEAVTSLLPQLIEVSSPITLQALVQCGQPQCSTHILQWLKRVHANPLLIDVVTYLVALIPEPSAQQLREIFNMARDQRSRATLYALSHAVNNYHKTNPTGTQELLDIANYLMEQIQDDCTGDEDYTYLILRVIGNMGQTMEQLTPELKSSILKCVQSTKPSLMIQKAAIQALRKMEPKDKDQEVLLQTFLDDASPGDKRLAAYLMLMRSPSQADINKIVQILPWEQNEQVKNFVASHIANILNSEELDIQDLKKLVKEALKESQLPTVMDFRKFSRNYQLYKSVSLPSLDPASAKIEGNLIFDPNNYLPKESMLKTTLTAFGFASADLIEIGLEGKGFEPTLEALFGKQGFFPDSVNKALYWVNGQVPDGVSKVLVDHFGYTKDDKHEQDMVNGIMLSVEKLIKDLKSKEVPEARAYLRILGEELGFASLHDLQLLGKLLLMGARTLQGIPQMIGEVIRKGSKNDFFLHYIFMENAFELPTGAGLQLQISSSGVIAPGAKAGVKLEVANMQAELVAKPSVSVEFVTNMGIIIPDFARSGVQMNTNFFHESGLEAHVALKAGKLKFIIPSPKRPVKLLSGGNTLHLVSTTKTEVIPPLIENRQSWSVCKQVFPGLNYCTSGAYSNASSTDSASYYPLTGDTRLELELRPTGEIEQYSVSATYELQREDRALVDTLKFVTQAEGAKQTEATMTFKYNRQSMTLSSEVQIPDFDVDLGTILRVNDESTEGKTSYRLTLDIQNKKITEVALMGHLSCDTKEERKIKGVISIPRLQAEARSEILAHWSPAKLLLQMDSSATAYGSTVSKRVAWHYDEEKIEFEWNTGTNVDTKKMTSNFPVDLSDYPKSLHMYANRLLDHRVPETDMTFRHVGSKLIVAMSSWLQKASGSLPYTQTLQDHLNSLKEFNLQNMGLPDFHIPENLFLKSDGRVKYTLNKNSLKIEIPLPFGGKSSRDLKMLETVRTPALHFKSVGFHLPSREFQVPTFTIPKLYQLQVPLLGVLDLSTNVYSNLYNWSASYSGGNTSTDHFSLRARYHMKADSVVDLLSYNVQGSGETTYDHKNTFTLSCDGSLRHKFLDSNIKFSHVEKLGNNPVSKGLLIFDASSSWGPQMSASVHLDSKKKQHLFVKEVKIDGQFRVSSFYAKGTYGLSCQRDPNTGRLNGESNLRFNSSYLQGTNQITGRYEDGTLSLTSTSDLQSGIIKNTASLKYENYELTLKSDTNGKYKNFATSNKMDMTFSKQNALLRSEYQADYESLRFFSLLSGSLNSHGLELNADILGTDKINSGAHKATLRIGQDGISTSATTNLKCSLLVLENELNAELGLSGASMKLTTNGRFREHNAKFSLDGKAALTELSLGSAYQAMILGVDSKNIFNFKVSQEGLKLSNDMMGSYAEMKFDHTNSLNIAGLSLDFSSKLDNIYSSDKFYKQTVNLQLQPYSLVTTLNSDLKYNALDLTNNGKLRLEPLKLHVAGNLKGAYQNNEIKHIYAISSAALSASYKADTVAKVQGVEFSHRLNTDIAGLASAIDMSTNYNSDSLHFSNVFRSVMAPFTMTIDAHTNGNGKLALWGEHTGQLYSKFLLKAEPLAFTFSHDYKGSTSHHLVSRKSISAALEHKVSALLTPAEQTGTWKLKTQFNNNEYSQDLDAYNTKDKIGVELTGRTLADLTLLDSPIKVPLLLSEPINIIDALEMRDAVEKPQEFTIVAFVKYDKNQDVHSINLPFFETLQEYFERNRQTIIVVVENVQRNLKHINIDQFVRKYRAALGKLPQQANDYLNSFNWERQVSHAKEKLTALTKKYRITENDIQIALDDAKINFNEKLSQLQTYMIQFDQYIKDSYDLHDLKIAIANIIDEIIEKLKSLDEHYHIRVNLVKTIHDLHLFIENIDFNKSGSSTASWIQNVDTKYQIRIQIQEKLQQLKRHIQNIDIQHLAGKLKQHIEAIDVRVLLDQLGTTISFERINDVLEHVKHFVINLIGDFEVAEKINAFRAKVHELIERYEVDQQIQVLMDKLVELTHQYKLKETIQKLSNVLQQVKIKDYFEKLVGFIDDAVKKLNELSFKTFIEDVNKFLDMLIKKLKSFDYHQFVDETNDKIREVTQRLNGEIQALELPQKAEALKLFLEETKATVAVYLESLQDTKITLIINWLQEALSSASLAHMKAKFRETLEDTRDRMYQMDIQQELQRYLSLVGQVYSTLVTYISDWWTLAAKNLTDFAEQYSIQDWAKRMKALVEQGFTVPEIKTILGTMPAFEVSLQALQKATFQTPDFIVPLTDLRIPSVQINFKDLKNIKIPSRFSTPEFTILNTFHIPSFTIDFVEMKVKIIRTIDQMQNSELQWPVPDIYLRDLKVEDIPLARITLPDFRLPEIAIPEFIIPTLNLNDFQVPDLHIPEFQLPHISHTIEVPTFGKLYSILKIQSPLFTLDANADIGNGTTSANEAGIAASITAKGESKLEVLNFDFQANAQLSNPKINPLALKESVKFSSKYLRTEHGSEMLFFGNAIEGKSNTVASLHTEKNTLELSNGVIVKINNQLTLDSNTKYFHKLNIPKLDFSSQADLRNEIKTLLKAGHIAWTSSGKGSWKWACPRFSDEGTHESQISFTIEGPLTSFGLSNKINSKHLRVNQNLVYESGSLNFSKLEIQSQVDSQHVGHSVLTAKGMALFGEGKAEFTGRHDAHLNGKVIGTLKNSLFFSAQPFEITASTNNEGNLKVRFPLRLTGKIDFLNNYALFLSPSAQQASWQVSARFNQYKYNQNFSAGNNENIMEAHVGINGEANLDFLNIPLTIPEMRLPYTIITTPPLKDFSLWEKTGLKEFLKTTKQSFDLSVKAQYKKNKHRHSITNPLAVLCEFISQSIKSFDRHFEKNRNNALDFVTKSYNETKIKFDKYKAEKSHDELPRTFQIPGYTVPVVNVEVSPFTIEMSAFGYVFPKAVSMPSFSILGSDVRVPSYTLILPSLELPVLHVPRNLKLSLPHFKELCTISHIFIPAMGNITYDFSFKSSVITLNTNAELFNQSDIVAHLLSSSSSVIDALQYKLEGTTRLTRKRGLKLATALSLSNKFVEGSHNSTVSLTTKNMEVSVAKTTKAEIPILRMNFKQELNGNTKSKPTVSSSMEFKYDFNSSMLYSTAKGAVDHKLSLESLTSYFSIESSTKGDVKGSVLSREYSGTIASEANTYLNSKSTRSSVKLQGTSKIDDIWNLEVKENFAGEATLQRIYSLWEHSTKNHLQLEGLFFTNGEHTSKATLELSPWQMSALVQVHASQPSSFHDFPDLGQEVALNANTKNQKIRWKNEVRIHSGSFQSQVELSNDQEKAHLDIAGSLEGHLRFLKNIILPVYDKSLWDFLKLDVTTSIGRRQHLRVSTAFVYTKNPNGYSFSIPVKVLADKFITPGLKLNDLNSVLVMPTFHVPFTDLQVPSCKLDFREIQIYKKLRTSSFALNLPTLPEVKFPEVDVLTKYSQPEDSLIPFFEITVPESQLTVSQFTLPKSVSDGIAALDLNAVANKIADFELPTIIVPEQTIEIPSIKFSVPAGIVIPSFQALTARFEVDSPVYNATWSASLKNKADYVETVLDSTCSSTVQFLEYELNVLGTHKIEDGTLASKTKGTLAHRDFSAEYEEDGKFEGLQEWEGKAHLNIKSPAFTDLHLRYQKDKKGISTSAASPAVGTVGMDMDEDDDFSKWNFYYSPQSSPDKKLTIFKTELRVRESDEETQIKVNWEEEAASGLLTSLKDNVPKATGVLYDYVNKYHWEHTGLTLREVSSKLRRNLQNNAEWVYQGAIRQIDDIDVRFQKAASGTTGTYQEWKDKAQNLYQELLTQEGQASFQGLKDNVFDGLVRVTQKFHMKVKHLIDSLIDFLNFPRFQFPGKPGIYTREELCTMFIREVGTVLSQVYSKVHNGSEILFSYFQDLVITLPFELRKHKLIDVISMYRELLKDLSKEAQEVFKAIQSLKTTEVLRNLQDLLQFIFQLIEDNIKQLKEMKFTYLINYIQDEINTIFNDYIPYVFKLLKENLCLNLHKFNEFIQNELQEASQELQQIHQYIMALREEYFDPSIVGWTVKYYELEEKIVSLIKNLLVALKDFHSEYIVSASNFTSQLSSQVEQFLHRNIQEYLSILTDPDGKGKEKIAELSATAQEIIKSQAIATKKIISDYHQQFRYKLQDFSDQLSDYYEKFIAESKRLIDLSIQNYHTFLIYITELLKKLQSTTVMNPYMKLAPGELTIIL

SEQ ID NO: 843 - protein, 439 aa, Homo sapiens
  misc_feature (0)...(0): Polypeptide Accession Number P04181
MFSKLAHLQRFAVLSRGVHSSVASATSVATKKTVQGPPTSDDIFEREYKYGAHNYHPLPVALERGKGIYLWDVEGRKYFDFLSSYSAVNQGHCHPKIVNALKSQVDKLTLTSRAFYNNVLGEYEEYITKLFNYHKVLPMNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 844 - protein, 643 aa, Homo sapiens
  misc_feature (0)...(0): Polypeptide Accession Number P04264
SRQFSSRSGYRSGGGFSSGSAGIINYQRRTTSSSTRRSGGGGGRFSSCGGGGGSFGAGGGFGSRSLVNLGGSKSISISVARGGGRGSGFGGGYGGGGFGGGGFGGGGFGGGGIGGGGFGGFGSGGGGFGGGGFGGGGYGGGYGPVCPPGGIQEVTINQSLLQPLNVEIDPEIQKVKSREREQIKSLNNQFASFIDKVRFLEQQNQVLQTKWELLQQVDTSTRTHNLEPYFESFINNLRRRVDQLKSDQSRLDSELKNMQDMVEDYRNKYEDEINKRTNAENEFVTIKKDVDGAYMTKVDLQAKLDNLQQEIDFLTALYQAELSQMQTQISETNVILSMDNNRSLDLDSIIAEVKAQNEDIAQKSKAEAESLYQSKYEELQITAGRHGDSVRNSKIEISELNRVIQRLRSEIDNVKKQISNLQQSISDAEQRGENALKDAKNKLNDLEDALQQAKEDLARLLRDYQELMNTKLALDLEIATYRTLLEGEESRMSGECAPNVSVSVSTSHTTISGGGSRGGGGGGYGSGGSSYGSGGGSYGSGGGGGGGRGSYGSGGSSYGSGGGSYGSGGGGGGHGSYGSGSSSGGYRGGSGGGGGGSSGGRGSGGGSSGGSIGGRGSSSGGVKSSGGSSSVRFVSTTYSGVTR

SEQ ID NO: 845 - protein, 331 aa, Homo sapiens
  misc_feature (0)...(0): Polypeptide Accession Number P04280
MLLILLSVALLALSSAQNLNEDVSQEESPSLIAGNPQGPSPQGGNKPQGPPPPPGKPQGPPPQGGNKPQGPPPPGKPQGPPPQGDKSRSPRSPPGKPQGPPPQGGNQPQGPPPPPGKPQGPPPQGGNKPQGPPPPGKPQGPPPQGDKSQSPRSPPGKPQGPPPQGGNQPQGPPPPPGKPQGPPQQGGNRPQGPPPPGKPQGPPPQGDKSRSPQSPPGKPQGPPPQGGNQPQGPPPPPGKPQGPPPQGGNKPQGPPPPGKPQGPPAQGGSKSQSARAPPGKPQGPPQQEGNNPQGPPPPAGGNPQQPQAPPAGQPQGPPRPPQGGRPSRPPQ

SEQ ID NO: 846 - protein, 114 aa, Homo sapiens
  misc_feature (0)...(0): Polypeptide Accession Number P04645
VAAKKTKKSLESINSRLQLVMKSGKYVLGYKQTLKMIRQGKAKLVILANNCPALRKSEIEYYAMLAKTGVHHYSGNNIELGTACGKYYRVCTLAIIDPGDSDIIRSMPEQTGEK

SEQ ID NO: 847 - protein, 406 aa, Homo sapiens
  misc_feature (0)...(0): Polypeptide Accession Number P04765
MSASQDSRSRDNGPDGMEPEGVIESNWNEIVDSFDDMNLSESLLRGIYAYGFEKPSAIQQRAILPCIKGYDVIAQAQSGTGKTATFAISILQQIELDLKATQALVLAPTRELAQQIQKVVMALGDYMGASCHACIGGTNVRAEVQKLQMEAPHIIVGTPGRVFDMLNRRYLSPKYIKMFVLDEADEMLSRGFKDQIYDIFQKLNSNTQVVLLSATMPSDVLEVTKKFMRDPIRILVKKEELTLEGIRQFYINVEREEWKLDTLCDLYETLTITQAVIFINTRRKVDWLTEKMHARDFTVSAMHGDMDQKERDVIMREFRSGSSRVLITTDLLARGIDVQQVSLVINYDLPTNRENYIHRIGRGGRFGRKGVAINMVTEEDKRTLRDIETFYNTSIEEMPLNVADLI

SEQ ID NO: 848 - protein, 340 aa, Homo sapiens [sequence omitted]

SEQ ID NO: 849 - protein, 129 aa, Homo sapiens
  misc_feature (0)...(0): Polypeptide Accession Number P04908
SGRGKQGGKARAKAKTRSSRAGLQFPVGRVHRLLRKAHYSERVGAGAPVYLAAVLEYLTAEILELAGNAARDNKKTRIIPRHLQLAIRNDEELNKLLGRVTIAQGGVLPNIQAVLLPKKTESHHKAKGK

SEQ ID NO: 850 - protein, 322 aa, Homo sapiens
  misc_feature (0)...(0): Polypeptide Accession Number P05089
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYREGLYITEEIYKTGLLSGLDIMEVNPSLGKTPEEVTRTVNTAVAITLACFGLAREGNHKPIDYLNPPK

SEQ ID NO: 851 - protein, 517 aa, Homo sapiens
  misc_feature (0)...(0): Polypeptide Accession Number P05091
MLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 852 - protein, 164 aa, Homo sapiens
  misc_feature (0)...(0): Polypeptide Accession Number P05092
VNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 853 - protein, 673 aa, Homo sapiens
  misc_feature (0)...(0): Polypeptide Accession Number P05127
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDFMGSLSFGISELQKASVDGWFKLLSQEEGEYFNVPVPPEGSEANEELRQKFERAKISQGTKVPEEKTTNTVSKFDNNGNRDRMKLTDFNFLMVLGKGSFGKVMLSERKGTDELYAVKILKKDVVIQDDDVECTMVEKRVLALPGKPPFLTQLHSCFQTMDRLYFVMEYVNGGDLMYHIQQVGRFKEPHAVFYAAEIAIGLFFLQSKGIIYRDLKLDNVMLDSEGHIKIADFGMCKENIWDGVTTKTFCGTPDYIAPEIIAYQPYGKSVDWWAFGVLLYEMLAGQAPFEGEDEDELFQSIMEHNVAYPKSMSKEAVAICKGLMTKHPGKRLGCGPEGERDIKEHAFFRYIDWEKLERKEIQPPYKPKACGRNAENFDRFFTRHPPVLTPPDQEVIRNIDQSEFEGFSFVNSEFLKPEVKS

SEQ ID NO: 854 - protein, 309 aa, Homo sapiens
  misc_feature (0)...(0): Polypeptide Accession Number P05323
MDEKVFTKELDQWIEQLNECKQLSESQVKSLCEKAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 855 - protein, 115 aa, Homo sapiens
  misc_feature (0)...(0): Polypeptide Accession Number P05387
MRYVASYLLAALGGNSSPSAKDIKKILDSVGIEADDDRLNKVISELNGKNIEDVIAQGIGKLASVPAGGAVAVSAAPGSAAPAAGSAPAAAEEKKDEKKEESEESDDDMGFGLFD

SEQ ID NO: 856 - protein, 331 aa, Homo sapiens
  misc_feature (0)...(0): Polypeptide Accession Number P05412
MTAKMETTFYDDALNASFLPSESGPYGYSNPKILKQSMTLNLADPVGSLKPHLRAKNSDLLTSPDVGLLKLASPELERLIIQSSNGHITTTPTPTQFLCPKNVTDEQEGFAEGFVRALAELHSQNTLPSVTSAAQPVNGAGMVAPAVASVAGGSGSGGFSASLHSEPPVYANLSNFNPGALSSGGGAPSYGAAGLAFPAQPQQQQQPPHHLPQQMPVQHPRLQALKEEPQTVPEMPGETPPLSPIDMESQERIKAERKRMRNRIAASKCRKRKLERIARLEEKVKTLKAQNSELASTANMLREQVAQLKQKVMNHVNSGCQLMLTQQLQTF

SEQ ID NO: 857 - protein, 395 aa, Homo sapiens
  misc_feature (0)...(0): Polypeptide Accession Number P05423
MSEGNAAGRPARQGPDLLLTGARGSSGGGGLPSPPAVPSIRSRDLTLGGVKKKTFTPNIISRKIKEEPKEEVTVKKEKRERDRDRQREGHGRGRRRPEVIQSHSIFEQGPAEMMKKKGNWDKTVDVSDMGPSHIINIKKEKRETDEETKQILRMLEKDDFLDDPGLRNDTRNMPVQLPLAHSGWLFKEENDEPDVKPWLAGPKEEDMEVDIPAVKVKEEPRDEEEEAKMKAPPKAARKTPGLPKDVSVAELLRELSLTKEEELLFLQLPDTLPGQPPTQDIKPIKTEVQGEDGQVVLIKQEKDREAKLAENACTLADLTEGQVGKLLIRKSGRVQLLLGKVTLDVTMGTACSFLQELVSVGLGDSRTGEMTVLGHVKHKLVCSPDFESLLDHKHR

SEQ ID NO: 858 - protein, 482 aa, Homo sapiens
  misc_feature (0)...(0): Polypeptide Accession Number P05787
SIRVTQKSYKVSTSGPRAFSSRSYTSGPGSRISSSSFSRVGSSNFRGGLGGGYGGASGMGGITAVTVNQSLLSPLVLEVDPNIQAVRTQEKEQIKTLNNKFASFIDKVRFLEQQNKMLETKWSLLQQQKTARSNMDNMFESYINNLRRQLETLGQEKLKLEAELGNMQGLVEDFKNKYEDEINKRTEMENEFVLIKKDVDEAYMNKVELESRLEGLTDEINFLRQLYEEEIRELQSQISDTSVVLSMDNSRSLDMDSIIAEVKAQYEDIANRSRAEAESMYQIKYEELQSLAGKHGDDLRRTKTEISEMNRNISRLQAEIEGLKGQRASLEAAIADAEQRGELAIKDANAKLSELEAALQRAKQDMARQLREYQELMNVKLALDIEIATYRKLLEGEESRLESGMQNMSIHTKTTGGYAGGLSSAYGGLTSPGLSYSLGSSFGSGAGSSSFSRTSSSRAVVVKKIETRDGKLVSESSDVLPK

SEQ ID NO: 859 - protein, 536 aa, Homo sapiens
  misc_feature (0)...(0): Polypeptide Accession Number P06241
GCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 860 - protein, 284 aa, Homo sapiens
  misc_feature (0)...(0): Polypeptide Accession Number P06468
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESRARQLEEELRTMDQALKSLMASEEEYSTKEDKYEEEIKLLEEKLKEAETRAEFAERSVAKLEKTIDDLEETLASAKEENVEIHQTLDQTLLELNNL

SEQ ID NO: 861 - protein, 294 aa, Homo sapiens
  misc_feature (0)...(0): Polypeptide Accession Number P06748
MEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEEEDVKLLSISGKRSAPGGGSKVPQKKVKLAADEDDDDDDEEDDDEDDDDDDFDDEEAEEKAPVKKSIRDTPAKNAQKSNQNGKDSKPSSTPRSKGQESFKKQEKTPKTPKGPSSVEDIKAKMQASIEKGGSLPKVEAKFINYVKNCFRMTDQEAIQDLWQWRKSL

SEQ ID NO: 862 - protein, 225 aa, Homo sapiens
  misc_feature (0)...(0): Polypeptide Accession Number P07029
PEEQFGGDGAAARATAAVGGSAGEQEGAMVAATQGAAAAAGSGAGPGAEPRLEAPKGQRQSEGAKIDASKNEEDEGHSNSSPRHSEAATAQREEWKMFIRALAGTLQRKISELLSNCKCSCTLSYILSQASRFALLFKESNVDKVMIKKNINSWKVIDPKRAKAMKTKEPVKKIFVGGLSPDTPEEKIREYFGGFGEVESIELPMDNKTNKRRGFCFITFNQEEP

SEQ ID NO: 863 - protein, 915 aa, Homo sapiens
  misc_feature (0)...(0): Polypeptide Accession Number P07197
SYTLDSLGNPSAYRRVTETRSSFSRVSGSPSSGFRSQSWSRGSPSTVSSSYKRSMLAPRLAYSSAMLSSAESSLDFSQSSSLLNGGSGPGGDYKLSRSNEKEQLQGLNDRFAGYIEKVHYLEQQNKEIEAEIQALRQKQASHAQLGDAYDQEIRELRATLEMVNHEKAQVQLDSDHLEEDIHRLKERFEEEARLRDDTEAAIRALRKDIEEASLVKVELDKKVQSLQDEVAFLRSNHEEEVADLLAQIQASHITVERKDYLKTDISTALKEIRSQLESHSDQNMHQAEEWFKCRYAKLTEAAEQNKEAIRSAKEEIAEYRRQLQSKSIELESVRGTKESLERQLSDIEERHNHDLSSYQDTIQQLENELRGTKWEMARHLREYQDLLNVKMALDIEIAAYRKLLEGEETRFSTFAGSITGPLYTHRPPITISSKIQKTKVEAPKLKVQHKFVEEIIEETKVEDEKSEMEEALTAITEELAASMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVPKSPVEEKGKSPVPKSPVEEKGKSPVPKSPVEEKGKSPVSKSPVEEKAKSPVPKSPVEEAKSKAEVGKGEQKEEEEKEVKEAPKEEKVEKKEEKPKDVPEKKKAESPVKEEAVAEVVTITKSVKVHLEKETKEEGKPLQQEKEKEKAGGEGGSEEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 864 - protein, 599 aa, Homo sapiens
  misc_feature (0)...(0): Polypeptide Accession Number P07199
MGPKRRQLTFREKSRIIQEVEENPDLRKGEIARRFNIPPSTLSTILKNKRAILASERKYGVASTCRKTNKLSPYDKLEGLLIAWFQQIRAAGLPVKGIILKEKALRIAEELGMDDFTASNGWLDRFRRRHGVVSCSGVARARARNAAPRTPAAPASPAAVPSEGSGGSTTGWRAREEQPPSVAEGYASQDVFSATETSLWYDFLPDQAAGLCGGDGRPRQATQRLSVLLCANADGSEKLPPLVAGKSAKPRAGQAGLPCDYTANSKGGVTTQALAKYLKALDTRMAAESRRVLLLAGRLAAQSLDTSGLRHVQLAFFPPGTVHPLERGVVQQVKGHYRQAMLLKAMAALEGQDPSGLQLGLTEALHFVAAAWQAVEPSDIAACFREAGFGGGPNATITTSLKSEGEEEEEEEEEEEEEEGEGEEEEEEGEEEEEEGGEGEELGEEEEVEEEGDVDSDEEEEEDEESSSEGLEAEDWAQGVVEAGGSFGAYGAQEEAQCPTLHFLEGGEDSDSDSEEEDDEEEDDEDEDDDDDEEDGDEVPVPSFGEAMAYFAMVKRYLTSFPIDDRVQSHILHLEHDLVHVTRKNHARQAGVRGLGHQS

SEQ ID NO: 865 - protein, 201 aa, Homo sapiens [sequence omitted]

SEQ ID NO: 866 - protein, 822 aa, Homo sapiens [sequence omitted]

SEQ ID NO: 867 - protein, 714 aa, Homo sapiens
  misc_feature (0)...(0): Polypeptide Accession Number P07384
MSEEIITPVYCTGVSAQVQKQRARELGLGRHENAIKYLGQDYEQLRVRCLQSGTLFRDEAFPPVPQSLGYKDLGPNSSKTYGIKWKRPTELLSNPQFIVDGATRTDICQGALGDCWLLAAIASLTLNDTLLHRVVPHGQSFQNGYAGIFHFQLWQFGEWVDVVVDDLLPIKDGKLVFVHSAEGNEFWSALLEKAYAKVNGSYEALSGGSTSEGFEDFTGGVTEWYELRKAPSDLYQIILKALERGSLLGCSIDISSVLDMEAITFKKLVKGHAYSVTGAKQVNYRGQVVSLIRMRNPWGEVEWTGAWSDSSSEWNNVDPYERDQLRVKMEDGEFWMSFRDFMREFTRLEICNLTPDALKSRTIRKWNTTLYEGTWRRGSTAGGCRNYPATFWVNPQFKIRLDETDDPDDYGDRESGCSFVLALMQKHRRRERRFGRDMETIGFAVYEVPPELVGQPAVHLKRDFFLANASRARSEQFINLREVSTRFRLPPGEYVVVPSTFEPNKEGDFVLRFFSEKSAGTVELDDQIQANLPDEQVLSEEEIDENFKALFRQLAGEDMEISVKELRTILNRIISKHKDLRTKGFSLESCRSMVNLMDRDGNGKLGLVEFNILWNRIRNYLSIFRKFDLDKSGSMSAYEMRMAIESAGFKLNKKLYELIITRYSEPDLAVDFDNFVCCLVRLETMFRFFKTLDTDLDGVVTFDLFKWLQLTMFA

SEQ ID NO: 868 - protein, 359 aa, Homo sapiens
  misc_feature (0)...(0): Polypeptide Accession Number P07585
MKATIILLLLAQVSWAGPFQQRGLFDFMLEDEASGIGPEVPDDRDFEPSLGPVCPFRCQCHLRVVQCSDLGLDKVPKDLPPDTTLLDLQNNKITEIKDGDFKNLKNLHALILVNNKISKVSPGAFTPLVKLERLYLSKNQLKELPEKMPKTLQELRAHENEITKVRKVTFNGLNQMIVIELGTNPLKSSGIENGAFQGMKKLSYIRIADTNITSIPQGLPPSLTELHLDGNKISRVDAASLKGLNNLAKLGLSFNSISAVDNGSLANTPHLRELHLDNNKLTRVPGGLAEHKYIQVVYLHNNNISVVGSSDFCPPGHNTKKASYSGVSLFSNPVQYWEIQPSTFRCVYVRSAIQLGNYK

SEQ ID NO: 869 - protein, 1786 aa, Homo sapiens
  misc_feature (0)...(0): Polypeptide Accession Number P07942
MGLLQLLAFSFLALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALRQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRACDCDPRGIETPQCDQSTGQCVCVEGVEGPRCDKCTRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMTCGTPPGASCSETECGGPNCRTDEGERKCGGPGCGGLVTVAHNAWQKAMDLDQDVLSALAEVEQLSKMVSEAKLRADEAKQSAEDILLKTNATKEKMDKSNEELRNLIKQIRNFLTQDSADLDSIEAVANEVLKMEMPSTPQQLQNLTEDIRERVESLSQVEVILQHSAADIARAEMLLEEAKRASKSATDVKVTADMVKEALEEAEKAQVAAEKAIKQADEDIQGTQNLLTSIESETAASEETLFNASQRISELERNVEELKRKAAQNSGEAEYIEKVVYTVKQSAEDVKKTLDGELDEKYKKVENLIAKKTEESADARRKAEMLQNEAKTLLAQANSKLQLLKDLERKYEDNQRYLEDKAQELARLEGEVRSLLKDISQKVAVYSTCL

SEQ ID NO: 870 - protein, 543 aa, Homo sapiens
  misc_feature (0)...(0): Polypeptide Accession Number P07947
MGCIKSKENKSPAIKYRPENTPEPVSTSVSHYGAEPTTVSPCPSSSAKGTAVNFSSLSMTPFGGSSGVTPFGGASSSFSVVPSSYPAGLTGGVTIFVALYDYEARTTEDLSFKKGERFQIINNTEGDWWEARSIATGKNGYIPSNYVAPADSIQAEEWYFGKMGRKDAERLLLNPGNQRGIFLVRESETTKGAYSLSIRDWDEIRGDNVKHYKIRKLDNGGYYITTRAQFDTLQKLVKHYTEHADGLCHKLTTVCPTVKPQTQGLAKDAWEIPRESLRLEVKLGQGCFGEVWMGTWNGTTKVAIKTLKPGTMMPEAFLQEAQIMKKLRHDKLVPLYAVVSEEPIYIVTEFMSKGSLLDFLKEGDGKYLKLPQLVDMAAQIADGMAYIERMNYIHRDLRAANILVGENLVCKIADFGLARLIEDNEYTARQGAKFPIKWTAPEAALYGRFTIKSDVWSFGILQTELVTKGRVPYPGMVNREVLEQVERGYRMPCPQGCPESLHELMNLCWKKDPDERPTFEYIQSFLEDYFTATEPQYQPGENL

SEQ ID NO: 871 - protein, 284 aa, Homo sapiens
  misc_feature (0)...(0): Polypeptide Accession Number P07951
MDAIKKKMQMLKLDKENAIDRAEQAEADKKQAEDRCKQLEEEQQALQKKLKGTEDEVEKYSESVKEAQEKLEQAEKKATDAEADVASLNRRIQLVEEELDRAQERLATALQKLEEAEKAADESERGMKVIENRAMKDEEKMELQEMQLKEAKHIAEDSDRKYEEVARKLVILEGELERSEERAEVAESKCGDLEEELKIVTNNLKSLEAQADKYSTKEDKYEEEIKLLEEKLKEAETRAEFAERSVAKLEKTIDDLEDEVYAQKMKYKAISEELDNALNDITSL

SEQ ID NO: 872 - protein, 785 aa, Homo sapiens
  misc_feature (0)...(0): Polypeptide Accession Number P08047
MSDQDHSMDEMTAVVKIEKGVGGNNGGNGNGGGAFSQARSSSTGSSSSTGGGGQESQPSPLALLAATCSRIESPNENSNNSQGPSQSGGTGELDLTATQLSQGANGWQIISSSSGATPTSKEQSGSSTNGSNGSESSKNRTVSGGQYVVAAAPNLQNQQVLTGLPGVMPNIQYQVIPQFQTVDGQQLQFAATGAQVQQDGSGQIQIIPGANQQIITNRGSGGNIIAAMPNLLQQAVPLQGLANNVLSGQTQYVTNVPVALNGNITLLPVNSVSAATLTPSSQAVTISSSGSQESGSQPVTSGTTISSASLVSSQASSSSFFTNANSYSTTTTTSNMGIMNFTTSGSSGTNSQGQTPQRVSGLQGSDALNIQQNQTSGGSLQAGQQKEGEQNQQTQQQQILIQPQLVQGGQALQALQAAPLSGQTFTTQAISQETLQNLQLQAVPNSGPIIIRTPTVGPNGQVSWQTLQLQNLQVQNPQAQTITLAPMQGVSLGQTSSSNTTLTPIASAASIPAGTVTVNAAQLSSMPGLQTINLSALGTSGIQVHPIQGLPLAIANAPGDHGAQLGLHGAGGDGIHDDTAGGEEGENSPDAQPQAGRRTRREACTCPYCKDSEGRGSGDPGKKKQHICHIQGCGKVYGKTSHLRAHLRWHTGERPFMCTWSYCGKRFTRSDELQRHKRTHTGEKKFACPECPKRFMRSDHLSKHIKTHQNKKGGPGVALSVGTLPLDSGAGSEGSGTATPSALITTNMVAMEAICPEGIARLANSGINVMQVADLQSINISGNGF

SEQ ID NO: 873 - protein, 330 aa, Homo sapiens
  misc_feature (0)...(0): Polypeptide Accession Number P08129
MSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 874 - protein, 1106 aa, Homo sapiens
  misc_feature (0)...(0): Polypeptide Accession Number P08151
MFNSMTPPPISSYGEPCCLRPLPSQGAPSVGTEGLSGPPFCHQANLMSGPHSYGPARETNSCTEGPLFSSPRSAVKLTKKRALSISPLSDASLDLQTVIRTSPSSLVAFINSRCTSPGGSYGHLSIGTMSPSLGFPAQMNHQKGPSPSFGVQPCGPHDSARGGMIPHPQSRGPFPTCQLKSELDMLVGKCREEPLEGDMSSPNSTGIQDPLLGMLDGREDLEREEKREPESVYETDCRWDGCSQEFDSQEQLVHHINSEHIHGERKEFVCHWGGCSRELRPFKAQYMLVVHMRRHTGEKPHKCTFEGCRKSYSRLENLKTHLRSHTGEKPYMCEHEGCSKAFSNASDRAKHQNRTHSNEKPYVCKLPGCTKRYTDPSSLRKHVKTVHGPDAHVTKRHRGDGPLPRAPSISTVEPKREREGGPIREESRLTVPEGAMKPQPSPGAQSSCSSDHSPAGSAANTDSGVEMTGNAGGSTEDLSSLDEGPCIAGTGLSTLRRLENLRLDQLHQLRPIGTRGLKLPSLSHTGTTVSRRVGPPVSLERRSSSSSSISSAYTVSRRSSLASPFPPGSPPENGASSLPGLMPAQHYLLRARYASARGGGTSPTAASSLDRIGGLPMPPWRSRAEYPGYNPNAGVTRRASDPAQAADRPAPARVQRFKSLGCVHTPPTVAGGGQNFDPYLPTSVYSPQPPSITENAAMDARGLQEEPEVGTSMVGSGLNPYMDFPPTDTLGYGGPEGAAAEPYGARGPGSLPLGPGPPTNYGPNPCPQQASYPDPTQETWGEFPSHSGLYPGPKALGGTYSQCPRLEHYGQVQVKPEQGCPVGSDSTGLAPCLNAHPSEGPPHPQPLFSHYPQPSPPQYLQSGPYTQPPPDYLPSEPRPCLDFDSPTHSTGQLKAQLVCNYVQSQQELLWEGGGREDAPAQEPSYQSPKFLGGSQVSPSRAKAPVNTYGPGFGPNLPNHKSGSYPTPSPCHENFVVGANRASHRAAAPPRLLPPLPTCYGPLKVGGTNPSCGHPEVGRLGGGPALYPPPEGQVCNPLDSLDLDNTQLDFVAILDEPQGLSPPPSHDQRGSSGHTPPPSGPPNMAVGNMSVLLRSLPGETEFLNSSA

SEQ ID NO: 875 - protein, 92 aa, Homo sapiens
  misc_feature (0)...(0): Polypeptide Accession Number P08578
MAYRGQGQKVQKVMVQPINLIFRYLQNRSRIQVWLYEQVNMRIEGCIIGFDEYMNLVLDDAEEIHSKTKSRKQLGRIMLKGDNITLLQSVSN

SEQ ID NO: 876 - protein, 437 aa, Homo sapiens
  misc_feature (0)...(0): Polypeptide Accession Number P08621
MTQFLPPNLLALFAPRDPIPYLPPLEKLPHEKHHNQPYCGIAPYIREFEDPRDAPPPTRAETREERMERKRREKIERRQQEVETELKMWDPHNDPNAQGDAFKTLFVARVNYDTTESKLRREFEVYGPIKRIHMVYSKRSGKPRGYAFIEYEHERDMHSAYKHADGKKIDGRRVLVDVERGRTVKGWRPRRLGGGLGGTRRGGADVNIRHSGRDDTSRYDERPGPSPLPHRDRDRDRERERRERSRERDKERERRRSRSRDRRRRSRSRDKEERRRSRERSKDKDRDRKRRSSRSRERARRERERKEELRGGGGDMAEPSEAGDAPPDDGPPGELGPDGPDGPEEKGRDRDRERRRSHRSERERRRDRDRDRDRDREHKRGERGSERGRDEARGGGGGQDNGLEGLGNDSRDMYMESEGGDGYLAPENGYLMEAAPE

SEQ ID NO: 877 - protein, 465 aa, Homo sapiens
  misc_feature (0)...(0): Polypeptide Accession Number P08670
STRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQIDVDVSKPDLTAALRDVRQQYESVAAKNLQEAEEWYKSKFADLSEAANRNNDALRQAKQESTEYRRQVQSLTCEVDALKGTNESLERQMREMEENFAVEAANYQDTIGRLQDEIQNMKEEMARHLREYQDLLNVKMALDIEIATYRKLLEGEESRISLPLPNFSSLNLRETNLDSLPLVDTHSKRTFLIKTVETRDGQVINETSQHHDDLE

SEQ ID NO: 878 - protein, 295 aa, Homo sapiens [sequence omitted]

SEQ ID NO: 879 - protein, 425 aa, Homo sapiens
  misc_feature (0)...(0): Polypeptide Accession Number P08910
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVGDDITMVICPGIANHSEKQYIRTFVDYAQKNGYRCAVLNHLGALPNIELTSPRMFTYGCTWEFGAMVNYIKKTYPLTQLVVVGFSLGGNIVCKYLGETQANQEKVLCCVSVCQGYSALRAQETFMQWDQCRRFYNFLMADNMKKIILSHRQALFGDHVKKPQSLEDTDLSRLYTATSLMQIDDNVMRKFHGYNSLKEYYEEESCMRYLHRIYVPLMLVNAADDPLVHESLLTIPKSLSEKRENVMFVLPLHGGHLGFFEGSVLFPEPLTWMDKLVVEYANAICQWERNKLQCSDTEQVEADLE

SEQ ID NO: 880 - protein, 207 aa, Homo sapiens
  misc_feature (0)...(0): Polypeptide Accession Number P09058
GISRDNWHKRRKTGGKRKPYHKKRKYELGRPAANTKIGPRRIHTVRVRGGNKKYRALRLDVGNFSWGSECCTRKTRIIDVVYNASNNELVRTKTLVKNCIVLIDSTPYRQWYESHYALPLGRKKGAKLTPEEEEILNKKRSKKIQKKYDERKKNAKISSLLEEQFQQGKLLACIASRPGQCGRADGYVLEGKELEFYLRKIKARKGK

SEQ ID NO: 881 - protein, 424 aa, Homo sapiens
  misc_feature (0)...(0): Polypeptide Accession Number P09110
MQRLQVVLGHLRGPADSGWMPQAAPCLSGAPQASAADVVVVHGRRTAICRAGRGGFKDTTPDELLSAVMTAVLKDVNLRPEQLGDICVGNVLQPGAGAIMARIAQFLSDIPETVPLSTVNRQCSSGLQAVASIAGGIRNGSYDIGMACGVESMSLADRGNPGNITSRLMEKEKARDCLIPMGITSENVAERFGISREKQDTFALASQQKAARAQSKGCFQAEIVPVTTTVHDDKGTKRSITVTQDEGIRPSTTMEGLAKLKPAFKKDGSTTAGNSSQVSDGAAAILLARRSKAEELGLPILGVLRSYAVVGVPPDIMGIGPAYAIPVALQKAGLTVSDVDIFEINEAFASQAAYCVEKLRLPPEKVNPLGGAVALGHPLGCTGARQVITLLNELKRRGKRAYGVVSMCIGTGMGAAAVFEYPGN

SEQ ID NO: 882 - protein, 317 aa, Homo sapiens
  misc_feature (0)...(0): Polypeptide Accession Number P09329
PNIKIFSGSSHQDLSQKIADRLGLELGKVVTKKFSNQETCVEIGESVRGEDVYIVQSGCGEINDNLMELLIMINACKIASASRVTAVIPCFPYARQDKKDKSRAPISAKLVANMLSVAGADHIITMDLHASQIQGFFDIPVDNLYAEPAVLKWIRENISEWRNCTIVSPDAGGAKRVTSIADRLNVDFALIHKERKKANEVDRMVLVGDVKDRVAILVDDMADTCGTICHAADKLLSAGATRVYAILTHGIFSGPAISRINNACFEAVVVTNTIPQEDKMKHCSKIQVIDISMILAEAIRRTHNGESVSYLFSHVPL

SEQ ID NO: 883 - protein, 214 aa, Homo sapiens
  misc_feature (0)...(0): Polypeptide Accession Number P09429
GKGDPKKPRGKMSSYAFFVQTCREEHKKKHPDASVNFSEFSKKCSERWKTMSAKEKGKFEDMAKADKARYEREMKTYIPPKGETKKKFKDPNAPKRPPSAFFLFCSEYRPKIKGEHPGLSIGDVAKKLGEMWNNTAADDKQPYEKKAAKLKEKYEKDIAAYRAKGKPDAAKKGVVKAEKSKKKKEEEEDEEDEEDEEEEEDEEDEDEEEDDDDE

SEQ ID NO: 884 - protein, 371 aa, Homo sapiens
  misc_feature (0)...(0): Polypeptide Accession Number P09651
SKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGGYGGGGPGYSGGSRGYGSGGQGYGNQGSGYGGSGSYDSYNNGGGRGFGGGSGSNFGGGGSYNDFGNYNNQSSNFGPMKGGNFGGRSSGPYGGGGQYFAKPRNQGGYGGSSSSSSYGSGRRF

SEQ ID NO: 885 - protein, 529 aa, Homo sapiens
  misc_feature (0)...(0): Polypeptide Accession Number P09769
MGCVFCKKLEPVATAKEDAGLEGDFRSYGAADHYGPDPTKARPASSFAHIPNYSNFSSQAINPGFLDSGTIRGVSGIGVTLFIALYDYEARTEDDLTFTKGEKFHILNNTEGDWWEARSLSSGKTGCIPSNYVAPVDSIQAEEWYFGKIGRKDAERQLLSPGNPQGAFLIRESETTKGAYSLSIRDWDQTRGDHVKHYKIRKLDMGGYYITTRVQFNSVQELVQHYMEVNDGLCNLLIAPCTIMKPQTLGLAKDAWEISRSSITLERRLGTGCFGDVWLGTWNGSTKVAVKTLKPGTMSPKAFLEEAQVMKLLRHDKLVQLYAVVSEEPIYIVTEFMCHGSLLDFLKNPEGQDLRLPQLVDMAAQVAEGMAYMERMNYIHRDLRAANILVGERLACKIADFGLARLIKDDEYNPCQGSKFPIKWTAPEAALFGRFTIKSDVWSFGILLTELITKGRIPYPGMNKREVLEQVEQGYHMPCPPGCPASLYEAMEQTWRLDPEERPTFEYLQSFLEDYFTSAEPQYQPGDQT

SEQ ID NO: 886 - protein, 1258 aa, Homo sapiens
  misc_feature (0)...(0): Polypeptide Accession Number P10070
MALTSINATPTQLSSSSNCLSDTNQNKQSSESAVSSTVNPVAIHKRSKVKTEPEGLRPASPLALTQGQVLDTAHVGVPFPSPQEQLADLKEDLDRDDCKQEAEVVIYETNCHWEDCTKEYDTQEQLVHHINNEHIHGEKKEFVCRWQACTREQKPFKAQYMLVVHMRRHTGEKPHKCTFEGCSKAYSRLENLKTHLRSHTGEKPYVCEHEGCNKAFSNASDRAKHQNRTHSNEKPYICKIPGCTKRYTDPSSLRKHVKTVHGPDAHVTKKQRNDVHLRTPLLKENGDSEAGTEPGGPESTEASSTSQAVEDCLHVRAIKTESSGLCQSSPGAQSSCSSEPSPLGSAPNNDSGVEMPGTGPGSLGDLTALDDTPPGADTSALAAPSAGGLQLRKHMTTMHRFEQLKKEKLKSLKDSCSWAGPTPHTRNTKLPPLPGSGSILENFSGSGGGGPAGLLPNPRLSELSASEVTMLSQLQERRDSSTSTVSSAYTVSRRSSGISPYFSSRRSSEASPLGAGRPHNASSADSYDPISTDASRRSSEASQCSGGSGLLNLTPAQQYSLRAKYAAATGGPPPTPLPGLERMSLRTRLALLDAAEGTLPAGCPRPLGPRRGSDGPTYGHGHAGAAPAFPHEAPGGGTRRASDPVRRPDALSLPRVQRFHSTHNVNPGPLPPCADRRGLRLQSHPSTDGGLARGAYSPRPPSISENVAMEAVAAGVDGAGPEADLGLPEDDLVLPDDVVQYIKAHASGALDEGTGQVYPTESTGFSDNPRLPSPGLHGQRRMVAADSNVGPSAPMLGGCQLGFGAPSSLNKNNMPVQWNEVSSGTVDSLASQVKPPPFPQGNLAVVQQKPAFGQYPGYSPQGLQASPGGLDSTQPHLQPRSGAPSQGIPRVNYMQQLRQPVAGSQCPGMTTTMSPHACYGQVHPQLSPSTISGALNQFPQSCSNMPAKPGHLGHPQQTEVAPDPTTMGNRHRELGVPNSALAGVPPPHPVQSYPQQSHHLAASMSQEGYHQVPSLLPARQPGFMEPQTGPMGVATAGFGLVQPRPPLEPSPTGRHRGVRAVQQQLAYARATGHAMAAMPSSQETAEAVPKGAMGNMGSVPPQPPPQDAGGAPDHSMLYYYGQIHMYEQDGGLENLGSCQVMRSQPPQPQACQDSIQPQPLPSPGVNQVSSTVDSQLLEAPQIDFDAIMDDGDHSSLFSGALSPSLLHSLSQNSSRLTTPRNSLTLPSIPAGISNMAVGDMSSMLTSLAEESKFLNMMT

SEQ ID NO: 887 - protein, 1596 aa, Homo sapiens [sequence omitted]

SEQ ID NO: 888 - protein, 234 aa, Homo sapiens
  misc_feature (0)...(0): Polypeptide Accession Number P10161
KPQGRRPQGGNQPQRPPPPPGKPQGPPPQGGNQSQGPPPHPGKPERPPPQGGNQSQGPPPHPGKPERPPPQGGNQSQGPPPTPGKPEGPPPQGGNQSQGPPPHPGKPERPPPQGGNQSHRPPPPPGKPERPPPQGGNQSQGPPPHPGKPEGPPPQEGNKSRSARSPPGKPQGPPQQEGNKPQGPPPPGKPQGPPPPGGNPQQPQAPPAGKPQGPPPPPQGGRPPRPAQGQQPPQ

SEQ ID NO: 889 - protein, 276 aa, Homo sapiens
  misc_feature (0)...(0): Polypeptide Accession Number P10162
KPQGRRPQGGNQPQRPPPPPGKPQGPPPQGGNQSQGPPPPPGKPEGRPPQGGNQSQGPPPHPGKPERPPPQGGNQSQGPPPHPGKPESRPPQGGHQSQGPPPTPGKPEGPPPQGGNQSQGTPPPPGKPEGRPPQGGNQSQGPPPHPGKPERPPPQGGNQSHRPPPPPGKPERPPPQGGNQSQGPPPHPGKPEGPPPQEGNKSRSARSPPGKPQGPPQQEGNKPQGPPPPGKPQGPPPPGGNPQQPQAPPAGKPQGPPPPPQGGRPPRPAQGQQPPQ

SEQ ID NO: 890 - protein, 247 aa, Homo sapiens
  misc_feature (0)...(0): Polypeptide Accession Number P10163
MLLILLSVALLALSSAESSSEDVSQEESLFLISGKPEGRRPQGGNQPQRPPPPPGKPQGPPPQGGNQSQGPPPPPGKPEGRPPQGGNQSQGPPPHPGKPERPPPQGGNQSQGTPPPPGKPERPPPQGGNQSHRPPPPPGKPERPPPQGGNQSQGPPPHPGKPEGPPPQEGNKSRSARSPPGKPQGPPQQEGNKPQGPPPPGKPQGPPPAGGNPQQPQDPPAGKPQGPPPPPQGGRPPRPAQGQQPPQ

SEQ ID NO: 891 - protein, 640 aa, Homo sapiens
  misc_feature (0)...(0): Polypeptide Accession Number P10242
MARRPRHSIYSSDEDDEDFEMCDHDYDGLLPKSGKRHLGKTRWTREEDEKLKKLVEQNGTDDWKVIANYLPNRTDVQCQHRWQKVLNPELIKGPWTKEEDQRVIELVQKYGPKRWSVIAKHLKGRIGKQCRERWHNHLNPEVKKTSWTEEEDRIIYQAHKRLGNRWAEIAKLLPGRTDNAIKNHWNSTMRRKVEQEGYLQESSKASQPAVATSFQKNSHLMGFAQAPPTAQLPATGQPTVNNDYSYYHISEAQNVSSHVPYPVALHVNIVNVPQPAAAAIQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQPCSSTWEPASCGKMEEQMTSSSQARKYVNAFSARTLVM

SEQ ID NO: 892 - protein, 752 aa, Homo sapiens
  misc_feature (0)...(0): Polypeptide Accession Number P10243
MAKRSRSEDEDDDLQYADHDYEVPQQKGLKKLWNRVKWTRDEDDKLKKLVEQHGTDDWTLIASHLQNRSDFQCQHRWQKVLNPELIKGPWTKEEDQRVIELVQKYGPKRWSLIAKHLKGRIGKQCRERWHNHLNPEVKKSSWTEEEDRIIYEAHKRLGNRWAEIAKLLPGRTDNSIKNHWNSTMRRKVEQEGYLQDGIKSERSSSKLQHKPCAAMDHMQTQNQFYIPVQIPGYQYVSPEGNCIEHVQPTSAFIQQPFIDEDPDKEKKIKELEMLLMSAENEVRRKRIPSQPGSFSSWSGSFLMDDNMSNTLNSLDEHTSEFYSMDENQPVSAQQNSPTKFLAVEANAVLSSLQTIPEFAETLELIESDPVAWSDVTSFDISDAAASPIKSTPVKLMRIQHNEGAMECQFNVSLVLEGKKNTCNGGNSEAVPLTSPNIAKFSTPPAILRKKRKMRVGHSPGSELRDGSLNDGGNMALKHTPLKTLPFSPSQFFNTCPGNEQLNIENPSFTSTPICGQKALITTPLHKETTPKDQKENVGFRTPTIRRSILGTTPRTPTPFKNALAAQEKKYGPLKIVSQPLAFLEEDIREVLKEETGTDLFLKEEDEPAYKSCKQENTASGKKVRKSLVLDNWEKEESGTQLLTEDISDMQSENRFTTSLLMIPLLEIHDNRCNLIPEKQDINSTNKTYTLTKKKPNPNTSKVVKLEKNLQSNCEWETVVYGKTEDQLIMTEQARRYLSTYTATSSTSRALIL

SEQ ID NO: 893 - protein, 700 aa, Homo sapiens
  misc_feature (0)...(0): Polypeptide Accession Number P10244
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQEPIGTDLDAVRTPEPLEEFPKREDQEGSPPETSLPYKWVVEAANLLIPAVGSSLSEALDLIESDPDAWCDLSKFDLPEEPSAEDSINNSLVQLQASHQQQVLPPRQPSALVPSVTEYRLDGHTISDLSRSSRGELIPISPSTEVGGSGIGTPPSVLKRQRKRRVALSPVTENSTSLSFLDSCNSLTPKSTPVKTLPFSPSQFLNFWNKQDTLELESPSLTSTPVCSQKVVVTTPLHRDKTPLHQKHAAFVTPDQKYSMDNTPHTPTPFKNALEKYGPLKPLPQTPHLEEDLKEVLRSEAGIELIIEDDIRPEKQKRKPGLRRSPIKKVRKSLALDIVDEDVKLMMSTLPKSLSLPTTAPSNSSSLTLSGIKEDNSLLNQGFLQAKPEKAAVAQKPRSHFTTPAPMSSAWKTVACGGTRDQLFMQEKARQLLGRLKPSHTSRTLILS

SEQ ID NO: 894 - protein, 334 aa, Homo sapiens
  misc_feature (0)...(0): Polypeptide Accession Number P10265
MWATIVGKRAKGPASGPTTNWGIPNSAICSSGFSGTTTPTVPSVSGNKPVTTIQQLSLTTSGSAAVDLCTIQAVSLLPGEPPQKIPTGVYGPLPEGTVGLILGRSSLNLKGVQIHTSVVDSDYKGEIQLVISSSIPWSASPRDRIAQLLLLPYIKGGNSEIKRIGGLVSTDPTGKAAYWASQVSENRPVCKAIIQGKQFEGLVDTGADVSIIALNQWPKNWPKQKAVTGLVGIGTASEVYQSMEILHCLGPDNQESTVQPMITSIPLNLWGRDLLQQWGAEITMPAPLYSPTSQKIMTKMGYIPGKGLGKNEDGIKVPVEAKINQEREGIGYPF

SEQ ID NO: 895 - protein, 919 aa, Homo sapiens
  misc_feature (0)...(0): Polypeptide Accession Number P10275
MEVQLGLGRVYPRPPSKTYRGAFQNLFQSVREVIQNPGPRHPEAASAAPPGASLLLLQQQQQQQQQQQQQQQQQQQQQETSPRQQQQQQGEDGSPQAHRRGPTGYLVLDEEQQPSQPQSALECHPERGCVPEPGAAVAASKGLPQQLPAPPDEDDSAAPSTLSLLGPTFPGLSSCSADLKDILSEASTMQLLQQQQQEAVSEGSSSGRAREASGAPTSSKDNYLGGTSTISDNAKELCKAVSVSMGLGVEALEHLSPGEQLRGDCMYAPLLGVPPAVRPTPCAPLAECKGSLLDDSAGKSTEDTAEYSPFKGGYTKGLEGESLGCSGSAAAGSSGTLELPSTLSLYKSGALDEAAAYQSRDYYNFPLALAGPPPPPPPPHPHARIKLENPLDYGSAWAAAAAQCRYGDLASLHGAGAAGPGSGSPSAAASSSWHTLFTAEEGQLYGPCGGGGGGGGGGGGGGGGGGGGGGGGEAGAVAPYGYTRPPQGLAGQESDFTAPDVWYPGGMVSRVPYPSPTCVKSEMGPWMDSYSGPYGDMRLETARDHVLPIDYYFPPQKTCLICGDEASGCHYGALTCGSCKVFFKRAAEGKQKYLCASRNDCTIDKFRRKNCPSCRLRKCYEAGMTLGARKLKKLGNLKLQEEGEASSTTSPTEETTQKLTVSHIEGYECQPIFLNVLEAIEPGVVCAGHDNNQPDSFAALLSSLNELGERQLVHVVKWAKALPGFRNLHVDDQMAVIQYSWMGLMVFAMGWRSFTNVNSRMLYFAPDLVFNEYRMHKSRMYSQCVRMRHLSQEFGWLQITPQEFLCMKALLLFSIIPVDGLKNQKFFDELRMNYIKELDRIIACKRKNPTSCSRRFYQLTKLLDSVQPIARELHQFTFDLLIKSHMVSVDFPEMMAEIISVQVPKILSGKVKPIYFHTQ

SEQ ID NO: 896 - protein, 314 aa, Homo sapiens
  misc_feature (0)...(0): Polypeptide Accession Number P10451
MRIAVICFCLLGITCAIPVKQADSGSSEEKQLYNKYPDAVATWLNPDPSQKQNLLAPQNAVSSEETNDFKQETLPSKSNESHDHMDDMDDEDDDDHVDSQDSIDSNDSDDVDDTDDSHQSDESHHSDESDELVTDFPTDLPATEVFTPVVPTVDTYDGRGDSVVYGLRSKSKKFRRPDIQYPDATDEDITSHMESEELNGAYKAIPVAQDLNAPSDWDSRGKDSYETSQLDDQSAETHSHKQSRLYKRKANDESNEHSDVIDSQELSKVSREFHSHEFHSHEDMLVVDPKSKEEDKHLKFRISHELDSASSEVN

SEQ ID NO: 897 - protein, 614 aa, Homo sapiens
  misc_feature (0)...(0): Polypeptide Accession Number P10515
MSPHCSTTYLRTLGRTTMFWKTTEGRDGKMAVQEFSEFGLLLQLLGSPGRRYYSLPPHQKVPLPSLSPTMQAGTIARWEKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVLLPALSPTMTMGTVQRWEKKVGEKLSEGDLLAEIETDKATIGFEVQEEGYLAKILVPEGTRDVPLGTPLCIIVEKEADISAFADYRPTEVTDLKPQVPPPTPPPVAAVPPTPQPLAPTPSTPCPATPAGPKGRVFVDPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 898 - protein, 381 aa, Homo sapiens
  misc_feature (0)...(0): Polypeptide Accession Number P10644
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVEVGRLGPSDYFGEIALLMNRPRAATVVARGPLKCVKLDRPRFERVLGPCSDILKRNIQQYNSFVSLSV

SEQ ID NO: 899 - protein, 340 aa, Homo sapiens
  misc_feature (0)...(0): Polypeptide Accession Number P11016
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDLRADQELLMYSHDNIICGITSVAFSRSGRLLLAGYDDFNCNIWDAMKGDRAGVLAGHDNRVSCLGVTDDGMAVATGSWDSFLKIWN

SEQ ID NO: 900 - protein, 1609 aa, Homo sapiens [sequence omitted]

SEQ ID NO: 901 - protein, 1940 aa, Homo sapiens
  misc_feature (0)...(0): Polypeptide Accession Number P11055
MSSDTEMEVFGIAAPFLRKSEKERIEAQNQPFDAKTYCFVVDSKEEYAKGKIKSSQDGKVTVETEDNRTLVVKPEDVYAMNPPKFDRIEDMAMLTHLNEPAVLYNLKDRYTSWMIYTYSGLFCVTVNPYKWLPVYNPEVVEGYRGKKRQEAPPHIFSISDNAYQFMLTDRENQSILITGESGAGKTVNTKRVIQYFATIAATGDLAKKKDSKMKGTLEDQIISANPLLEAFGNAKTVRNDNSSRFGKFIRIHFGTTGKLASADIETYLLEKSRVTFQLKAERSYHIFYQILSNKKPELIELLLITTNPYDYPFISQGEILVASIDDREELLATDSAIDILGFTPEEKSGLYKLTGAVMHYGNMKFKQKQREEQAEPDGTEVADKTAYLMGLNSSDLLKALCFPRVKVGNEYVTKGQTVDQVHHAVNALSKSVYEKLFLWMVTRINQQLDTKLPRQHFIGVLDIAGFEIFEYNSLEQLCINFTNEKLQQFFNHHMFVLEQEEYKKEGIEWTFIDFGMDLAACIELIEKPMGIFSILEEECMFPKATDTSFKNKLYDQHLGKSNNFQKPKVVKGRAEAHFSLIHYAGTVDYSVSGWLEKNKDPLNETVVGLYQKSSNRLLAHLYATFATADADSGKKKVAKKKGSSFQTVSALFRENLNKLMSNLRTTHPHFVRCIIPNETKTPGAMEHSLVLHQLRCNGVLEGIRICRKGFPNRILYGDFKQRYRVLNASAILEGQFIDSKKACEKLLASIDIDHTQYKFGHTKVFFKAGLLGTLEEMRDDRLAKLITRTQAVCRGFLMRVEFQKMVQRRESIFCIQYNIRSFMNVKHWPWMKLFFKIKPLLKSAETEKEMATMKEEFQKTKDELAKSEAKRKELEEKLVTLVQEKNDLQLQVQAESENLLDAEERCDQLIKAKFQLEAKIKEVTERAEDEEEINAELTAKKRKLEDECSELKKDIDDLELTLAKVEKEKHATENKVKNLTEELSGLDETIAKLTREKKALQEAHQQALDDLQAEEDKVNSLNKTKSKLEQQVEDLESSLEQEKKLRVDLERNKRKLEGDLKLAQESILDLENDKQQLDERLKKKDFEYCQLQSKVEDEQTLGLQFQKKIKELQARIEELEEEIEAERATRAKTEKQRSDYARELEELSERLEEAGGVTSTQIELNKKREAEFLKLRRDLEEATLQHEAMVATLRKKHADSVAELGEQIDNLQRVKQKLEKEKSEFKLEIDDLSSSMESVSKSKANLEKICRTLEDQLSEARGKNEEIQRSLSELTTQKSRLQTEAGELSRQLEEKESIVSQLSRSKQAFTQQTEELKRQLEEENKAKNALAHALQSSRHDCDLLREQYEEEQEGKAELQRALSKANSEVAQWRTKYETDAIQRTEELEEAKKKLAQRLQDSEEQVEAVNAKCASLEKTKQRLQGEVEDLMVDVERANSLAAALDKKQRNFDKVLAEWKTKCEESQAELEASLKESRSLSTELFKLKNAYEEALDQLETVKRENKNLEQEIADLTEQIAENGKTIHELEKSRKQIELEKADIQLALEEAEAALEHEEAKILRIQLELTQVKSEIDRKIAEKDEEIEQLKRNYQRTVETMQSALDAEVRSRNEAIRLKKKMEGDLNEIEIQLSHANRQAAETLKHLRSVQGQLKDTQLHLDDALRGQEDLKEQLAIVERRANLLQAEVEELRATLEQTERARKLAEQELLDSNERVQLLHTQNTSLIHTKKKLETDLMQLQSEVEDASRDARNAEEKAKKAITDAAMMAEELKKEQDTSAHLERMKKNLEQTVKDLQHRLDEAEQLALKGGKKQIQKLETRIRELEFELEGEQKKNTESVKGLRKYERRVKELTYQSEEDRKNVLRLQDLVDKLQVKVKSYKRQAEEADEQANAHLTKFRKAQHELEEAEERADIAESQVNKLRAKTRDFTSSRMVVHESEE

SEQ ID NO: 902 - protein, 309 aa, Homo sapiens
  misc_feature (0)...(0): Polypeptide Accession Number P11082
MDDKAFTKELDQWVEQLNECKQLNENQVRTLCEKAKEILTKESNVQEVRCPVTVCGDVHGQFHDLMELFRIGGKSPDTNYLFMGDYVDRGYYSVETVTLLVALKVRYPERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 903 - protein, 476 aa, Homo sapiens
  misc_feature (0)...(0): Polypeptide Accession Number P11161
MMTAKAVDKIPVTLSGFVHQLSDNIYPVEDLAATSVTIFPNAELGGPFDQMNGVAGDGMINIDMTGEKRSLDLPYPSSFAPVSAPRNQTFTYMGKFSIDPQYPGASCYPEGIINIVSAGILQGVTSPASTTASSSVTSASPNPLATGPLGVCTMSQTQPDLDHLYSPPPPPPPYSGCAGDLYQDPSAFLSAATTSTSSSLAYPPPPSYPSPKPATDPGLFPMIPDYPGFFPSQCQRDLHGTAGPDRKPFPCPLDTLRVPPPLTPLSTIRNFTLGGPSAGMTGPGASGGSEGPRLPGSSSAAAAAAAAAAYNPHHLPLRPILRPRKYPNRPSKTPVHERPYPCPAEGCDRRFSRSDELTRHIRIHTGHKPFQCRICMRNFSRSDHLTTHIRTHTGEKPFACDYCGRKFARSDERKRHTKIHLRQKERKSSAPSASVPAPSTASCSGGVQPGGTLCSSNSSSLGGGPLAPCSSRTRTP

SEQ ID NO: 904 - protein, 359 aa, Homo sapiens [sequence omitted]

SEQ ID NO: 905 - protein, 482 aa, Homo sapiens
  misc_feature (0)...(0): Polypeptide Accession Number P11182
MAAVRMLRTWSRNAGKLICVRYFQTCGNVHVLKPNYVCFFGYPSFKYSHPHHFLKTTAALRGQVVQFKLSDIGEGIREVTVKEWYVKEGDTVSQFDSICEVQSDKASVTITSRYDGVIKKLYYNLDDIAYVGKPLVDIETEALKDSEEDVVETPAVSHDEHTHQEIKGRKTLATPAVRRLAMENNIKLSEVVGSGKDGRILKEDILNYLEKQTGAILPPSPKVEIMPPPPKPKDMTVPILVSKPPVFTGKDKTEPIKGFQKAMVKTMSAALKIPHFGYCDEIDLTELVKLREELKPIAFARGIKLSFMPFFLKAASLGLLQFPILNASVDENCQNITYKASHNIGIAMDTEQGLIVPNVKNVQICSIFDIATELNRLQKLGSVGQLSTTDLTGGTFTLSNIGSIGGTFAKPVIMPPEVAIGALGSIKAIPRFNQKGEVYKAQIMNVSWSADHRVIDGATMSRFSNLWKSYLENPAFMLLDLK

SEQ ID NO: 906 - protein, 765 aa, Homo sapiens
  misc_feature (0)...(0): Polypeptide Accession Number P11387
MSGDHLHNDSQIEADFRLNDSHKHKDKHKDREHRHKEHKKEKDREKSKHSNSEHKDSEKKHKEKEKTKHKDGSSEKHKDKHKDRDKEKRKEEKVRASGDAKIKKEKENGFSSPPQIKDEPEDDGYFVPPKEDIKPLKRPRDEDDADYKPKKIKTEDTKKEKKRKLEEEEDGKLKKPKNKDKDKKVPEPDNKKKKPKKEEEQKWKWWEEERYPEGIKWKFLEHKGPVFAPPYEPLPENVKFYYDGKVMKLSPKAEEVATFFAKMLDHEYTTKEIFRKNFFKDWRKEMTNEEKNIITNLSKCDFTQMSQYFKAQTEARKQMSKEEKLKIKEENEKLLKEYGFCIMDNHKERIANFKIEPPGLFRGRGNHPKMGMLKRRIMPEDIIINCSKDAKVPSPPPGHKWKEVRHDNKVTWLVSWTENIQGSIKYIMLNPSSRIKGEKDWQKYETARRLKKCVDKIRNQYREDWKSKEMKVRQRAVALYFIDKLALRAGNEKEEGETADTVGCCSLRVEHINLHPELDGQEYVVEFDFLGKDSIRYYNKVPVEKRVFKNLQLFMENKQPEDDLFDRLNTGILNKHLQDLMEGLTAKVFRTYNASITLQQQLKELTAPDENIPAKILSYNRANRAVAILCNHQRAPPKTFEKSMMNLQTKIDAKKEQLADARRDLKSAKADAKVMKDAKTKKVVESKKKAVQRLEEQLMKLEVQATDREENKQIALGTSKLNYLDPRITVAWCKKWGVPIEKIYNKTQREKFAWAIDMADEDYEF

SEQ ID NO: 907 - protein, 157 aa, Homo sapiens
  misc_feature (0)...(0): Polypeptide Accession Number P11441
MQLTVKALQGRECSLQVPEDELVSTLKQLVSEKLNVPVRQQRLLFKGKALADGKRLSDYSIGPNSKLNLVVKPLEKVLLEEGEAQRLADSPPPQVWQLISKVLARHFSAADASRVLEQLQRDYERSLSRLTLDDIERLASRFLHPEVTETMEKGFSK

SEQ ID NO: 908 - protein, 373 aa, Homo sapiens
  misc_feature (0)...(0): Polypeptide Accession Number P11766
ANEVIKCKAAVAWEAGKPLSIEEIEVAPPKAHEVRIKIIATAVCHTDAYTLSGADPEGCFPVILGHEGAGIVESVGEGVTKLKAGDTVIPLYIPQCGECKFCLNPKTNLCQKIRVTQGKGLMPDGTSRFTCKGKTILHYMGTSTFSEYTVVADISVAKIDPLAPLDKVCLLGCGISTGYGAAVNTAKLEPGSVCAVFGLGGVGLAVIMGCKVAGASRIIGVDINKDKFARAKEFGATECINPQDFSKPIQEVLIEMTDGGVDYSFECIGNVKVMRAALEACHKGWGVSVVVGVAASGEEIATRPFQLVTGRTWKGTAFGGWKSVESVPKLVSEYMSKKIKVDEFVTHNLSFDEINKAFELMHSGKSIRTVVKI

SEQ ID NO: 909 - protein, 317 aa, Homo sapiens
  misc_feature (0)...(0): Polypeptide Accession Number P11908
PNIVLFSGSSHQDLSQRVADRLGLELGKVVTKKFSNQETSVEIGESVRGEDVYIIQSGCGEINDNLMELLIMINACKIASSSRVTAVIPCFPYARQDKKDKSRAPISAKLVANMLSVAGADHIITMDLHASQIQGFFDIPVDNLYAEPAVLQWIRENIAEWKNCIIVSPDAGGAKRVTSIADRLNVEFALIHKERKKANEVDRMVLVGDVKDRVAILVDDMADTCGTICHAADKLLSAGATKVYAILTHGIFSGPAISRINNAAFEAVVVTNTIPQEDKMKHCTKIQVIDISMILAEAIRRTHNGESVSYLFSHVPL

SEQ ID NO: 910 - protein, 636 aa, Homo sapiens
  misc_feature (0)...(0): Polypeptide Accession Number P11940
MNPSAPSYPMASLYVGDLHPDVTEAMLYEKFSPAGPILSIRVCRDMITRRSLGYAYVNFQQPADAERALDTMNFDVIKGKPVRIMWSQRDPSLRKSGVGNIFIKNLDKSIDNKALYDTFSAFGNILSCKVVCDENGSKGYGFVHFETQEAAERAIEKMNGMLLNDRKVFVGRFKSRKEREAELGARAKEFTNVYIKNFGEDMDDERLKDLFGKFGPALSVKVMTDESGKSKGFGFVSFERHEDAQKAVDEMNGKELNGKQIYVGRAQKKVERQTELKRKFEQMKQDRITRYQGVNLYVKNLDDGIDDERLRKEFSPFGTITSAKVMMEGGRSKGFGFVCFSSPEEATKAVTEMNGRIVATKPLYVALAQRKEERQAHLTNQYMQRMASVRAVPNPVINPYQPAPPSGYFMAAIPQTQNRAAYYPPSQIAQLRPSPRWTAQGARPHPFQNMPGAIRPAAPRPPFSTMRPASSQVPRVMSTQRVANTSTQTMGPRPAAAAAAATPAVRTVPQYKYAAGVRNPQQHLNAQPQVTMQQPAVHVQGQEPLTASMLASAPPQEQKQMLGERLFPLIQAMHPTLAGKITGMLLEIDNSELLHMLESPESLRSKVDEAVAVLQAHQAKEAAQKAVNSATGVPTV

SEQ ID NO: 911 - protein, 1020 aa, Homo sapiens [sequence omitted]

SEQ ID NO: 912 - protein, 122 aa, Homo sapiens
  misc_feature (0)...(0): Polypeptide Accession Number P12079
MCAARLSAAAQSTVYAFSARPLTGGEPVSLGSLRGKVLLIENVASLCGTTIRDYTEMNDLQKRLGLVVLGFPCNQFGHQVYGARWVALGSRLPRAGHRLLSPLVLQLECRPILGYTRRATSW

SEQ ID NO: 913 - protein, 514 aa, Homo sapiens
  misc_feature (0)...(0): Polypeptide Accession Number P12268
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGKLPIVNEDDELVAIIARTDLKKNRDYPLASKDAKKQLLCGAAIGTHEDDKYRLDLLAQAGVDVVVLDSSQGNSIFQINMIKYIKDKYPNLQVIGGNVVTAAQAKNLIDAGVDALRVGMGSGSICITQEVLACGRPQATAVYKVSEYARRFGVPVIADGGIQNVGHIAKALALGASTVMMGSLLAATTEAPGEYFFSDGIRLKKYRGMGSLDAMDKHLSSQNRYFSEADKIKVAQGVSGAVQDKGSIHKFVPYLIAGIQHSCQDIGAKSLTQVRAMMYSGELKFEKRTSSAQVEGGVHSLHSYEKRLF

SEQ ID NO: 914 - protein, 2349 aa, Homo sapiens
  misc_feature (0)...(0): Polypeptide Accession Number P12270
MAAVLQQVLERTELNKLPKSVQNKLEKFLADQQSEIDGLKGRHEKFKVESEQQYFEIEKRLSHSQERLVNETRECQSLRLELEKLNNQLKALTEKNKELEIAQDRNIAIQSQFTRTKEELEAEKRDLIRTNERLSQELEYLTEDVKRLNEKLKESNTTKGELQLKLDELQASDVSVKYREKRLEQEKELLHSQNTWLNTELKTKTDELLALGREKGNEILELKCNLENKKEEVSRLEEQMNGLKTSNEHLQKHVEDLLTKLKEAKEQQASMEEKFHNELNAHIKLSNLYKSAADDSEAKSNELTRAVEELHKLLKEAGEANKAIQDHLLEVEQSKDQMEKEMLEKIGRLEKELENANDLLSATKRKGAILSEEELAAMSPTAAAVAKIVKPGMKLTELYNAYVETQDQLLLEKLENKRINKYLDEIVKEVEAKAPILKRQREEYERAQKAVASLSVKLEQAMKEIQRLQEDTDKANKQSSVLERDNRRMEIQVKDLSQQIRVLLMELEEARGNHVIRDEEVSSADISSSSEVISQHLVSYRNIEELQQQNQRLLVALRELGETREREEQETTSSKITELQLKLESALTELEQLRKSRQHQMQLVDSIVRQRDMYRILLSQTTGVAIPLHASSLDDVSLASTPKRPSTSQTVSTPAPVPVIESTEAIEAKAALKQLQEIFENYKKEKAENEKIQNEQLEKLQEQVTDLRSQNTKISTQLDFASKRYEMLQDNVEGYRREITSLHERNQKLTATTQKQEQIINTMTQDLRGANEKLAVAEVRAENLKKEKEMLKLSEVRLSQQRESLLAEQRGQNLLLTNLQTIQGILERSETETKQRLSSQIEKLEHEISHLKKKLENEVEQRHTLTRNLDVQLLDTKRQLDTETNLHLNTKELLKNAQKEIATLKQHLSNMEVQVASQSSQRTGKGQPSNKEDVDDLVSQLRQTEEQVNDLKERLKTSTSNVEQYQAMVTSLEESLNKEKQVTEEVRKNIEVRLKESAEFQTQLEKKLMEVEKEKQELQDDKRRAIESMEQQLSELKKTLSSVQNEVQEALQRASTALSNEQQARRDCQEQAKIAVEAQNKYERELMLHAADVEALQAAKEQVSKMASVRQHLEETTQKAESQLLECKASWEERERMLKDEVSKCVCRCEDLEKQNRLLHDQIEKLSDKVVASVKEGVQGPLNVSLSEEGKSQEQILEILRFIRREKEIAETRFEVAQVESLRYRQRVELLERELQELEDSLNAEREKVQVTAKTMAQHEELMKKTETMNVVMETNKMLREEKERLEQDLQQMQAKVRKLELDILPLQEANAELSEKSGMLQAEKKLLEEDVKRWKARNQHLVSQQKDPDTEEYRKLLSEKEVHTKRIQQLTEEIGRLKAEIARSNASLTNNQNLIQSLKEDLNKVRTEKETIQKDLDAKIIDIQEKVKTITQVKKIGRRYKTQYEELKAQQDKVMETSAQSSGDHQEQHVSVQEMQELKETLNQAETKSKSLESQVENLQKTLSEKETEARNLQEQTVQLQSELSRLRQDLQDRTTQEEQLRQQITEKEEKTRKAIVAAKSKIAHLAGVKDQLTKENEELKQRNGALDQQKDELDVRITALKSQYEGRISRLERELREHQERHLEQRDEPQEPSNKVPEQQRQITLKTTPASGERGIASTSDPPTANIKPTPVVSTPSKVTAAAMAGNKSTPRASIRPMVTPATVTNPTTTPTATVMPTTQVESQEAMQSEGPVEHVPVFGSTSGSVRSTSPNVQPSISQPILTVQQQTQATAFVQPTQQSHPQIEPANQELSSNIVEVVQSSPVERPSTSTAVFGTVSATPSSSLPKRTREEEEDSTIEASDQVSDDTVEMPLPKKLKSVTPVGTEEEVMAEESTDGEVETQVYNQDSQDSIGEGVTQGDYTPMEDSEETSQSLQIDLGPLQSDQQTTTSSQDGQGKGDDVIVIDSDDEEEDEEDDDDDEDDTGMGDEGEDSNEGTGSADGNDGYEADDAEGGDGTDPGTETEESMGGGEGNHRAADSQNSGEGNTGAAESSFSQEVSREQQPSSASERQAPRAPQSPRRPPHPLPPRLTIHAPPQELGPPVQRIQMTRRQSVGRGLQLTPGIGGMQQHFFDDEDRTVPSTPTLVVPHRTDGFAEAIHSPQVAGVPRFRFGPPEDMPQTSSSHSDLGQLASQGGLGMYETPLFLAHEEESGGRSVPTTPLQVAAPVTVFTESTTSDASEHASQSVPMVTTSTGTLSTTNETATGDDGDEVFVEAESEGISSEAGLEIDSQQEEEPVQASDESDLPSTSQDPPSSSSVDTSSSQPKPFRRVRLQTTLRQGVRGRQFNRQRGVSHAMGGRGGINRGNIN

SEQ ID NO: 915 - protein, 1939 aa, Homo sapiens
  misc_feature (0)...(0): Polypeptide Accession Number P12882
MSSDSEMAIFGEAAPFLRKSERERIEAQNKPFDAKTSVFVVDPKESFVKATVQSREGGKVTAKTEAGATVTVKDDQVFPMNPPKYDKIEDMAMMTHLHEPAVLYNLKERYAAWMIYTYSGLFCVTVNPYKWLPVYNAEVVTAYRGKKRQEAPPHIFSISDNAYQFMLTDRENQSILITGESGAGKTVNTKRVIQYFATIAVTGEKKKEEVTSGKMQGTLEDQIISANPLLEAFGNAKTVRNDNSSRFGKFIRIHFGTTGKLASADIETYLLEKSRVTFQLKAERSYHIFYQIMSNKKPDLIEMLLITTNPYDYAFVSQGEITVPSIDDQEELMATDSAIEILGFTSDERVSIYKLTGAVMHYGNMKFKQKQREEQAEPDGTEVADKAAYLQNLNSADLLKALCYPRVKVGNEYVTKGQTVQQVYNAVGALAKAVYDKMFLWMVTRINQQLDTKQPRQYFIGVLDIAGFEIFDFNSLEQLCINFTNEKLQQFFNHHMFVLEQEEYKKEGIEWTFIDFGMDLAACIELIEKPMGIFSILEEECMFPKATDTSFKNKLYEQHLGKSNNFQKPKPAKGKPEAHFSLIHYAGTVDYNIAGWLDKNKDPLNETVVGLYQKSAMKTLALLFVGATGAEAEAGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIDIDHTQYKFGHTKVFFKAGLLGLLEEMRDEKLAQLITRTQAMCRGFLARVEYQKMVERRESIFCIQYNVRAFMNVKHWPWMKLYFKIKPLLKSAETEKEMANMKEEFEKTKEELAKTEAKRKELEEKMVTLMQEKNDLQLQVQAEADSLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKIRMDLERAKRKLEGDLKLAQESAMDIENDKQQLDEKLKKKEFEMSGLQSKIEDEQALGMQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNMETVSKAKGNLEKMCRALEDQLSEIKTKEEEQQRLINDLTAQRARLQTESGEYSRQLDEKDTLVSQLSRGKQAFTQQIEELKRQLEEEIKAKSALAHALQSSRHDCDLLREQYEEEQEAKAELQRAMSKANSEVAQWRTKYETDAIQRTEELEEAKKKLAQRLQDAEEHVEAVNAKCASLEKTKQRLQNEVEDLMIDVERTNAACAALDKKQRNFDKILAEWKQKCEETHAELEASQKESRSLSTELFKIKNAYEESLDQLETLKRENKNLQQEISDLTEQIAEGGKRIHELEKIKKQVEQEKSELQAALEEAEASLEHEEGKILRIQLELNQVKSEVDRKIAEKDEEIDQMKRNHIRIVESMQSTLDAEIRSRNDAIRLKKKMEGDLNEMEIQLNHANRMAAEALRNYRNTQAILKDTQLHLDDALRSQEDLKEQLAMVERRANLLQAEIEELRATLEQTERSRKIAEQELLDASERVQLLHTQNTSLINTKKKLETDISQIQGEMEDIIQEARNAEEKAKKAITDAAMMAEELKKEQDTSAHLERMKKNLEQTVKDLQHRLDEAEQLALKGGKKQIQKLEARVRELEGEVESEQKRNVEAVKGLRKHERKVKELTYQTEEDRKNILRLQDLVDKLQAKVKSYKRQAEEAEEQSNVNLSKFRRIQHELEEAEERADIAESQVNKLRVKSREVHTKIISEE

SEQ ID NO: 916 - protein, 1935 aa, Homo sapiens
  misc_feature (0)...(0): Polypeptide Accession Number P12883
MGDSEMAVFGAAAPYLRKSEKERLEAQTRPFDLKKDVFVPDDKQEFVKAKIVSREGGKVTAETEYGKTVTVKEDQVMQQNPPKFDKIEDMAMLTFLHEPAVLYNLKDRYGSWMIYTYSGLFCVTVNPYKWLPVYTPEVVAAYRGKKRSEAPPHIFSISDNAYQYMLTDRENQSILITGESGAGKTVNTKRVIQYFAVIAAIGDRSKKDQSPGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTSEEKNSMYKLTGAIMHFGNMKFKLKQREEQAEPDGTEEADKSAYLMGLNSADLLKGLCHPRVKVGNEYVTKGQNVQQVIYATGALAKAVYERMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLFDNHLGKSANFQKPRNIKGKPEAHFSLIHYAGIVDYNIIGWLQKNKDPLNETVVGLYQKSSLKLLSTLFANYAGADAPIEKGKGKAKKGSSFQTVSALHRENLNKLMTNLRSTHPHFVRCIIPNETKSPGVMDNPLVMHQLRCNGVLEGIRICRKGFPNRILYGDFRQRYRILNPAAIPEGQFIDSRKGAEKLLSSLDIDHNQYKFGHTKVFFKAGLLGLLEEMRDERLSRIITRIQAQSRGVLARMEYKKLLERRDSLLVIQWNIRAFMGVKNWPWMKLYFKIKPLLKSAEREKEMASMKEEFTRLKEALEKSEARRKELEEKMVSLLQEKNDLQLQVQAEQDNLADAEERCDQLIKNKIQLEAKVKEMNERLEDEEEMNAELTAKKRKLEDECSELKRDIDDLELTLAKVEKEKHATENKVKNLTEEMAGLDEIIAKLTKEKKALQEAHQQALDDLQAEEDKVNTLTKAKVKLEQQVDDLEGSLEQEKKVRMDLERAKRKLEGDLKLTQESIMDLENDKQQLDERLKKKDFELNALNARIEDEQALGSQLQKKLKELQARIEELEEELESERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKMCRTLEDQMNEHRSKAEETQRSVNDLTSQRAKLQTENGELSRQLDEKEALISQLTRGKLTYTQQLEDLKRQLEEEVKAKNALAHALQSARHDCDLLREQYEEETEAKAELQRVLSKANSEVAQWRTKYETDAIQRTEELEEAKKKLAQRLQEAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGSSGKTIHELEKVRKQLEAEKMELQSALEEAEASLEHEEGKILRAQLEFNQIKAEIERKLAEKDEEMEQAKRNHLRVVDSLQTSLDAETRSRNEALRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMDADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 917 - protein, 1939 aa, Homo sapiens
  misc_feature (0)...(0): Polypeptide Accession Number P13533
MTDAQMADFGAAAQYLRKSEKERLEAQTRPFDIRTECFVPDDKEEFVKAKILSREGGKVIAETENGKTVTVKEDQVLQQNPPKFDKIQDMAMLTFLHEPAVLFNLKERYAAWMIYTYSGLFCVTVNPYKWLPVYNAEVVAAYRGKKRSEAPPHIFSISDNAYQYMLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQALALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGEGGKNVHELEKVRKQLEVEKLELQSALEEAEASLEHEEGKILRAQLEFNQIKAEIERKLAEKDEEMEQAKRNHQRVVDSLQTSLDAETRSRNEVLRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMEADLTQLQSEVEEAVQECRNAEEKAKKAITDAAMMAEELKKEQDTSAHLERMKKNMEQTIKDLQHRLDEAEQIALKGGKKQLQKLEARVRELEGELEAEQKRNAESVKGMRKSERRIKELTYQTEEDKKNLLRLQDLVDKLQLKVKAYKRQAEEAEEQANTNLSKFRKVQHELDEAEERADIAESQVNKLRAKSRDIGAKQKMHDEE

SEQ ID NO: 918 - protein, 1937 aa, Homo sapiens
  misc_feature (0)...(0): Polypeptide Accession Number P13535
MSASSDAEMAVFGEAAPYLRKSEKERIEAQNKPFDAKTSVFVAEPKESYVKSTIQSKEGGKVTVKTEGGATLTVREDQVFPMNPPKYDKIEDMAMMTHLHEPGVLYNLKERYAAWMIYTYSGLFCVTVNPYKWLPVYKPEVVAAYRGKKRQEAPPHIFSISDNAYQFMLTDRENQSILITGESGAGKTVNTKRVIQYFATIAVTGEKKKDESGKMQGTLEDQIISANPLLEAFGNAKTVRNDNSSRFGKFIRIHFGTTGKLASADIETYLLEKSRVTFQLKAERSYHIFYQITSNKKPDLIEMLLITTNPYDYAFVSQGEITVPSIDDQEELMATDSAIDILGFTPEEKVSIYKLTGAVMHYGNMKFKQKQREEQAEPDGTEVADKAAYLQSLNSADLLKALCYPRVKVGNEYVTKGQTVQQVYNAVGALAKAVYEKMFLWMVTRINQQLDTKQPRQYFIGVLDIAGFEIFDFNSLEQLCINFTNEKLQQFFNHHMFVLEQEEYKKEGIEWTFIDFGMDLAACIELIEKPLGIFSILEEECMFPKATDTSFKNKLYDQHLGKSANFQKPKVVKGKAEAHFSLIHYAGTVDYNITGWLDKNKDPLNDTVVGLYQKSAMKTLASLFSTYASAEADSSAKKGAKKKGSSFQTVSALFRENLNKLMTNLRSTHPHFVRCIIPNETKTPGAMEHELVLHQLRCNGVLEGIRICRKGFPSRILYGDFKQRYKVLNASAIPEGQFIDSKKASEKLLASIDIDHTQYKFGHTKVFFKAGLLGLLEEMRDEKLAQIITRTQAVCRGFLMRVEYQKMLQRREALFCIQYNVRAFMNVKHWPWMKLFFKIKPLLKSAETEKEMATMKEEFQKTKDELAKSEAKRKELEEKMVTLLKEKNDLQLQVQSEADSLADAEERCEQLIKNKIQLEAKIKEVTERAEEEEEINAELTAKKRKLEDECSELKKDIDDLELTLAKVEKEKHATENKVKNLTEEMAGLDETIAKLSKEKKALQETHQQTLDDLQAEEDKVNILTKAKTKLEQQVDDLEGSLEQEKKLRMDLERAKRKLEGDLKLAQESTMDMENDKQQLDEKLEKKEFEISNLISKIEDEQAVEIQLQKKIKELQARIEELGEEIEAERASRAKAEKQRSDLSRELEEISERLEEAGGATSAQVELNKKREAEFQKLRRDLEEATLQHEAMVAALRKKHADSMAELGEQIDNLQRVKQKLEKEKSELKMETDDLSSNAEAISKAKGNLEKMCRSLEDQVSELKTKEEEQQRLINDLTAQRARLQTEAGEYSRQLDEKDALVSQLSRSKQASTQQIEELKHQLEEETKAKNALAHALQSSRHDCDLLREQYEEEQEGKAELQRALSKANSEVAQWRTKYETDAIQRTEELEEAKKKLAQRLQEAEEHVEAVNAKCASLEKTKQRLQNEVEDLMLDVERSNAACAALDKKQRNFDKVLSEWKQKYEETQAELEASQKESRSLSTELFKVKNVYEESLDQLETLRRENKNLQQEISDLTEQIAEGGKQIHELEKIKKQVEQEKCEIQAALEEAEASLEHEEGKILRIQLELNQVKSEVDRKIAEKDEEIDQLKRNHTRVVETMQSTLDAEIRSRNDALRVKKKMEGDLNEMEIQLNHANRLAAESLRNYRNTQGILKETQLHLDDALRGQEDLKEQLAIVERRANLLQAEIEELWATLEQTERSRKIAEQELLDASERVQLLHTQNTSLINTKKKLENDVSQLQSEVEEVIQESRNAEEKAKKAITDAAMMAEELKKEQDTSAHLERMKKNLEQTVKDLQHRLDEAEQLALKGGKKQIQKLEARVRELEGEVENEQKRNAEAVKGLRKHERRVKELTYQTEEDRKNVLRLQDLVDKLQAKVKSYKRQAEEAEEQSNANLSKFRKLQHELEEAEERADIAESQVNKLRVKSREVHTKISAE

SEQ ID NO: 919 - protein, 593 aa, Homo sapiens
  misc_feature (0)...(0): Polypeptide Accession Number P13645
MSVRYSSSKHYSSSRSGGGGGGGGCGGGGGVSSLRISSSKGSLGGGFSSGGFSGGSFSRGSSGGGCFGGSSGGYGGLGGFGGGSFHGSYGSSSFGGSYGGSFGGGNFGGGSFGGGSFGGGGFGGGGFGGGFGGGFGGDGGLLSGNEKVTMQNLNDRLASYLDKVRALEESNYELEGKIKEWYEKHGNSHQGEPRDYSKYYKTIDDLKNQILNLTTDNANILLQIDNARLAADDFRLKYENEVALRQSVEADINGLRRVLDELTLTKADLEMQIESLTEELAYLKKNHEEEMKDLRNVSTGDVNVEMNAAPGVDLTQLLNNMRSQYEQLAEQNRKDAEAWFNEKSKELTTEIDNNIEQISSYKSEITELRRNVQALEIELQSQLALKQSLEASLAETEGRYCVQLSQIQAQISALEEQLQQIRAETECQNTEYQQLLDIKIRLENEIQTYRSLLEGEGSSGGGGRGGGSFGGGYGGGSSGGGSSGGGYGGGHGGSSGGGYGGGSSGGGSSGGGYGGGSSSGGHGGGSSSGGHGGSSSGGYGGGSSGGGGGGYGGGSSGGGSSSGGGYGGGSSSGGHKSSSSGSVGESSSKGPRY

SEQ ID NO: 920 - protein, 645 aa, Homo sapiens
  misc_feature (0)...(0): Polypeptide Accession Number P13667
MRPRKAFLLLLLLGLVQLLAVAGAEGPDEDSSNRENAIEDEEEEEEEDDDEEEDDLEVKEENGVLVLNDANFDNFVADKDTVLLEFYAPWCGHCKQFAPEYEKIANILKDKDPPIPVAKIDATSASVLASRFDVSGYPTIKILKKGQAVDYEGSRTQEEIVAKVREVSQPDWTPPPEVTLVLTKENFDEVVNDADIILVEFYAPWCGHCKKLAPEYEKAAKELSKRSPPIPLAKVDATAETDLAKRFDVSGYPTLKIFRKGRPYDYNGPREKYGIVDYMIEQSGPPSKEILTLKQVQEFLKDGDDVIIIGVFKGESDPAYQQYQDAANNLREDYKFHHTFSTEIAKFLKVSQGQLVVMQPEKFQSKYEPRSHMMDVQGSTQDSAIKDFVLKYALPLVGHRKVSNDAKRYTRRPLVVVYYSVDFSFDYRAATQFWRSKVLEVAKDFPEYTFAIADEEDYAGEVKDLGLSESGEDVNAAILDESGKKFAMEPEEFDSDTLREFVTAFKKGKLKPVIKSQPVPKNNKGPVKVVVGKTFDSIVMDPKKDVLIEFYAPWCGHCKQLEPVYNSLAKKYKGQKGLVIAKMDATANDVPSDRYKVEGFPTIYFAPSGDKKNPVKFEGGDRDLEHLSKFIEEHATKLSRTKEEL

SEQ ID NO: 921 - protein, 737 aa, Homo sapiens
  misc_feature (0)...(0): Polypeptide Accession Number P13807
MPLNRTLSMSSLPGLEDWEDEFDLENAVLFEVAWEVANKVGGIYTVLQTKAKVTGDEWGDNYFLVGPYTEQGVRTQVELLEAPTPALKRTLDSMNSKGCKVYFGRWLIEGGPLVVLLDVGASAWALERWKGELWDTCNIGVPWYDREANDAVLFGFLTTWFLGEFLAQSEEKPHVVAHFHEWLAGVGLCLCRARRLPVATIFTTHATLLGRYLCAGAVDFYNNLENFNVDKEAGERQIYHRYCMERAAAHCAHVFTTVSQITAIEAQHLLKRKPDIVTPNGLNVKKFSAMHEFQNLHAQSKARIQEFVRGHFYGHLDFNLDKTLYFFIAGRYEFSNKGADVFLEALARLNYLLRVNGSEQTVVAFFIMPARTNNFNVETLKGQAVRKQLWDTANTVKEKFGRKLYESLLVGSLPDMNKMLDKEDFTMMKRAIFATQRQSFPPVCTHNMLDDSSDPILTTIRRIGLFNSSADRVKVIFHPEFLSSTSPLLPVDYEEFVRGCHLGVFPSYYEPWGYTPAECTVMGIPSISTNLSGFGCFMEEHIADPSAYGIYILDRRFRSLDDSCSQLTSFLYSFCQQSRRQRIIQRNRTERLSDLLDWKYLGRYYMSARHMALSKAFPEHFTYEPNEADAAQGYRYPRPASVPPSPSLSRHSSPHQSEDEEDPRNGPLEEDGERYDEDEEAAKDRRNIRAPEWPRRASCTSSTSGSKRNSVDTATSSSLSTPSEPLSPTSSLGEERN

SEQ ID NO: 922 - protein, 403 aa, Homo sapiens
  misc_feature (0)...(0): Polypeptide Accession Number P13861
SHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEEEDTDPRVIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEVSERMKIVDVIGEKIYKDGERIITQGEKADSFYIIESGEVSILIRSRTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 923 - protein, 215 aa, Homo sapiens
  misc_feature (0)...(0): Polypeptide Accession Number P13862
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPRLYGFKIHPMAYQLQLQAASNFKSPVKTIR

SEQ ID NO: 924 - protein, 327 aa, Homo sapiens
  misc_feature (0)...(0): Polypeptide Accession Number P14061
ARTVVLITGCSSGIGLHLAVRLASDPSQSFKVYATLRDLKTQGRLWEAARALACPPGSLETLQLDVRDSKSVAAARERVTEGRVDVLVCNAGLGLLGPLEALGEDAVASVLDVNVVGTVRMLQAFLPDMKRRGSGRVLVTGSVGGLMGLPFNDVYCASKFALEGLCESLAVLLLPFGVHLSLIECGPVHTAFMEKVLGSPEEVLDRTDIHTFHRFYQYLAHSKQVFREAAQNPEEVAEVFLTALRAPKPTLRYFTTERFLPLLRMRLDDPSGSNYVTAMHREVFGDVPAKAEAGAEAGGGAGPGAEDEAGRSAVGDPELGDPPAAPQ

SEQ ID NO: 925 - protein, 527 aa, Homo sapiens
  misc_feature (0)...(0): Polypeptide Accession Number P14314
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTEPSRCEYLMELMTPAACPEPPPEAPTEDDHDEL

SEQ ID NO: 926 - protein, 486 aa, Homo sapiens [sequence omitted]

SEQ ID NO: 927 - protein, 686 aa, Homo sapiens
  misc_feature (0)...(0): Polypeptide Accession Number P14619
MGTLRDLQYALQEKIEELRQRDALIDELELELDQKDELIQKLQNELDKYRSVIRPATQQAQKQSASTLQGEPRTKRQAISAEPTAFDIQDLSHVTLPFYPKSPQSKDLIKEAILDNDFMKNLELSQIQEIVDCMYPVEYGKDSCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGEDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 928 - protein, 433 aa, Homo sapiens
  misc_feature (0)...(0): Polypeptide Accession Number P14635
MALRVTRNSKINAENKAKINMAGAKRVPTAPAATSKPGLRPRTALGDIGNKVSEQLQAKMPMKKEAKPSATGKVIDKKLPKPLEKVPMLVPVPVSEPVPEPEPEPEPEPVKEEKLSPEPILVDTASPSPMETSGCAPAEEDLCQAFSDVILAVNDVDAEDGADPNLCSEYVKDIYAYLRQLEEEQAVRPKYLLGREVTGNMRAILIDWLVQVQMKFRLLQETMYMTVSIIDRFMQNNCVPKKMLQLVGVTAMFIASKYEEMYPPEIGDFAFVTDNTYTKHQIRQMEMKILRALNFGLGRPLPLHFLRRASKIGEVDVEQHTLAKYLMELTMLDYDMVHFPPSQIAAGAFCLALKILDNGEWTPTLQHYLSYTEESLLPVMQHLAKNVVMVNQGLTKHMTVKNKYATSKHAKISTLPQLNSALVQDLAKAVAKV

SEQ ID NO: 929 - protein, 240 aa, Homo sapiens [sequence omitted]

SEQ ID NO: 930 - protein, 240 aa, Homo sapiens
  misc_feature (0)...(0): Polypeptide Accession Number P14678
MTVGKSSKMLQHIDYRMRCILQDGRIFIGTFKAFDKHMNLILCDCDEFRKIKPKNSKQAEREEKRVLGLVLLRGENLVSMTVEGPPPKDTGIARVPLAGAAGGPGIGRAAGRGIPAGVPMPQAPAGLAGPVRGVGGPSQQVMTPQGRGTVAAAAAAATASIAGAPTQYPPGRGGPPPPMGRGAPPPGMMGPPPGMRPPMGPPMGIPPGRGTPMGMPPPGMRPPPPGMRGPPPPGMRPPRP

SEQ ID NO: 931 - protein, 266 aa, Homo sapiens [sequence omitted]

SEQ ID NO: 932 - protein, 845 aa, Homo sapiens
  misc_feature (0)...(0): Polypeptide Accession Number P15498
MELWRQCTHWLIQCRVLPPSHRVTWDGAQVCELAQALRDGVLLCQLLNNLLPHAINLREVNLRPQMSQFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPPKMTEYDKRCCCLREIQQTEEKYTDTLGSIQQHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 933 - protein, 152 aa, Homo sapiens
  misc_feature (0)...(0): Polypeptide Accession Number P15531
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 934 - protein, 406 aa, Homo sapiens
  misc_feature (0)...(0): Polypeptide Accession Number P15735
MTLDVGPEDELPDWAAAKEFYQKYDPKDVIGRGVSSVVRRCVHRATGHEFAVKIMEVTAERLSPEQLEEVREATRRETHILRQVAGHPHIITLIDSYESSSFMFLVFDLMRKGELFDYLTEKVALSEKETRSIMRSLLEAVSFLHANNIVHRDLKPENILLDDNMQIRLSDFGFSCHLEPGEKLRELCGTPGYLAPEILKCSMDETHPGYGKEVDLWACGVILFTLLAGSPPFWHRRQILMLRMIMEGQYQFSSPEWDDRSSTVKDLISRLLQVDPEARLTAEQALQHPFFERCEGSQPWNLTPRQRFRVAVWTVLAAGRVALSTHRVRPLTKNALLRDPYALRSVRHLIDNCAFRLYGHWVKKGEQQNRAALFQHRPPGPFPIMGPEEEGDSAAITEDEAVLVLG

SEQ ID NO: 935 - protein, 1043 aa, Homo sapiens
  misc_feature (0)...(0): Polypeptide Accession Number P15918
MAASFPPTLGLSSAPDEIQHPHIKFSEWKFKLFRVRSFEKTPEEAQKEKKDSFEGKPSLEQSPAVLDKADGQKPVPTQPLLKAHPKFSKKFHDNEKARGKAIHQANLRHLCRICGNSFRADEHNRRYPVHGPVDGKTLGLLRKKEKRATSWPDLIAKVFRIDVKADVDSIHPTEFCHNCWSIMHRKFSSAPCEVYFPRNVTMEWHPHTPSCDICNTARRGLKRKSLQPNLQLSKKLKTVLDQARQARQRKRRAQARISSKDVMKKIANCSKIHLSTKLLAVDFPEHFVKSISCQICEHILADPVETNCKHVFCRVCILRCLKVMGSYCPSCRYPCFPTDLESPVKSFLSVLNSLMVKCPAKECNEEVSLEKYNHHISSHKESKEIFVHINKGGRPRQHLLSLTRRAQKHRLRELKLQVKAFADKEEGGDVKSVCMTLFLLALRARNEHRQADELEAIMQGKGSGLQPAVCLAIRVNTFLSCSQYHKMYRTVKAITGRQIFQPLHALRNAEKVLLPGYHHFEWQPPLKNVSSSTDVGIIDGLSGLSSSVDDYPVDTIAKRFRYDSALVSALMDMEEDILEGMRSQDLDDYLNGPFTVVVKESCDGMGDVSEKHGSGPVVPEKAVRFSFTIMKITIAHSSQNVKVFEEAKPNSELCCKPLCLMLADESDHETLTAILSPLIAEREAMKSSELMLELGGILRTFKFIFRGTGYDEKLVREVEGLEASGSVYICTLCDATRLEASQNLVFHSITRSHAENLERYEVWRSNPYHESVEELRDRVKGVSAKPFIETVPSIDALHCDIGNAAEFYKIFQLEIGEVYKNPNASKEERKRWQATLDKHLRKKMNLKPIMRMNGNFARKLMTKETVDAVCELIPSEERHEALRELMDLYLKMKPVWRSSCPAKECPESLCQYSFNSQRFAELLSTKFKYRYEGKITNYFHKTLAHVPEIIERDGSIGAWASEGNESGNKLFRRFRKMNARQSKCYEMEDVLKHHWLYTSKYLQKFMNAHNALKTSGFTMNPQASLGDPLGIEDSLESQDSMEF

SEQ ID NO: 936 - protein, 2871 aa, Homo sapiens
  misc_feature (0)...(0): Polypeptide Accession Number P15924
MSCNGGSHPRINTLGRMIRAESGPDLRYEVTSGGGGTSRMYYSRRGVITDQNSDGYCQTGTMSRHQNQNTIQELLQNCSDCLMRAELIVQPELKYGDGIQLTRSRELDECFAQANDQMEILDSLIREMRQMGQPCDAYQKRLLQLQEQMRALYKAISVPRVRRASSKGGGGYTCQSGSGWDEFTKHVTSECLGWMRQQRAEMDMVAWGVDLASVEQHINSHRGIHNSIGDYRWQLDKIKADLREKSAIYQLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDRKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATSVKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 937 - protein, 142 aa, Homo sapiens
  misc_feature (0)...(0): Polypeptide Accession Number P16104
SGRGKTGGKARAKAKSRSSRAGLQFPVGRVHRLLRKGHYAERVGAGAPVYLAAVLEYLTAEILELAGNAARDNKKTRIIPRHLQLAIRNDEELNKLLGGVTIAQGGVLPNIQAVLLPKKTSATVGPKAPSGGKKATQASQEY

SEQ ID NO: 938 - protein, 471 aa, Homo sapiens
  misc_feature (0)...(0): Polypeptide Accession Number P16118
MSPEMGELTQTRLQKIWIPHSSGSSRLQRRRGSSIPQFTNSPTMVIMVGLPARGKTYISTKLTRYLNWIGTPTKVFNLGQYRREAVSYKNYEFFLPDNMEALQIRKQCALAALKDVHNYLSHEEGHVAVFDATNTTRERRSLILQFAKEHGYKVFFIESICNDPGIIAENIRQVKLGSPDYIDCDREKVLEDFLKRIECYEVNYQPLDEELDSHLSYIKIFDVGTRYMVNRVQDHIQSRTVYYLMNIHVTPRSIYLCRHGESELNIRGRIGGDSGLSVRGKQYAYALANFIQSQGISSLKVWTSHMKRTIQTAEALGVPYEQWKALNEIDAGVCEEMTYEEIQEHYPEEFALRDQDKYRYRYPKGESYEDLVQRLEPVIMELERQENVLVICHQAVMRCLLAYFLDKSSDELPYLKCPLHTVLKLTPVAYGCKVESIYLNVEAVNTHREKPENVDITREPEEALDTVPAHY

SEQ ID NO: 939 - protein, 377 aa, Homo sapiens
  misc_feature (0)...(0): Polypeptide Accession Number P16333
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIKGTKVIVMEKCSDGWWRGSYNGQVGWFPSNYVTEEGDSPLGDHVGSLSEKLAAVVNNLNTGQVLHVVQALYPFSSSNDEELNFEKGDVMDVIEKPENDPEWWKCRKINGMVGLVPKNYVTVMQNNPLTSGLEPSPPQCDYIRPSLTGKFAGNPWYYGKVTRHQAEMALNERGHEGDFLIRDSESSPNDFSVSLKAQGKNKHFKVQLKETVYCIGQRKFSTMEELVEHYKKAPIFTSEQGEKLYLVKHLS

SEQ ID NO: 940 - protein, 340 aa, Homo sapiens [sequence omitted]

SEQ ID NO: 941 - protein, 822 aa, Homo sapiens
  misc_feature (0)...(0): Polypeptide Accession Number P16591
MGFGSDLKNSHEAVLKLQDWELRLLETVKKFMALRIKSDKEYASTLQNLCNQVDKESTVQMNYVSNVSKSWLLMIQQTEQLSRIMKTHAEDLNSGPLHRLTMMIKDKQQVKKSYIGVHQQIEAEMIKVTKTELEKLKCSYRQLIKEMNSAKEKYKEALAKGKETEKAKERYDKATMKLHMLHNQYVLALKGAQLHQNQYYDITLPLLLDSLQKMQEEMIKALKGIFDEYSQITSLVTEEIVNVHKEIQMSVEQIDPSTEYNNFIDVHRTTAAKEQEIEFDTSLLEENENLQANEIMWNNLTAESLQVMLKTLAEELMQTQQMLLNKEEAVLELEKRIEESSETCEKKSDIVLLLSQKQALEELKQSVQQLRCTEAKFSAQKELLEQKVQENDGKEPPPVVNYEEDARSVTSMERKERLSKFESIRHSIAGIIRSPKSAVGSSALSDMISISEKPLAEQDWYHGAIPRIEAQELLKKQGDFLVRESHGKPGEYVLSVYSDGQRRHFIIQYVDNMYRFEGTGFSNIPQLIDHHYTTKQVITKKSGVVLLNPIPKDKKWILSHEDVILGELLGKGNFGEVYKGTLKDKTSVAVKTCKEDLPQELKIKFLQEAKILKQYDHPNIVKLIGVCTQRQPVYIIMELVSGGDFLTFLRRKKDELKLKQLVKFSLDAAAGMLYLESKNCIHRDLAARNCLVGENNVLKISDFGMSRQEDGGVYSSSGLKQIPIKWTAPEALNYGRYSSESDVWSFGILLWETFSLGVCPYPGMTNQQAREQVERGYRMSAPQHCPEDISKIMMKCWDYKPENRPKFSELQKELTIIKRKLT

SEQ ID NO: 942 - protein, 242 aa, Homo sapiens
  misc_feature (0)...(0): Polypeptide Accession Number P17032
IHTGERPYGCHECGKSFSEKSTLTQHQRTHTGEKPYECHECGKTFSFKSVLTVHQKTHTGEKPYECYACGKAFLRKSDLIKHQRIHTGEKPYECNECGKSFSEKSTLTKHLRTHTGEKPYECIQCGKFFCYYSGFTEHLRRHTGEKPFGCNECGKTFRQKSALIVHQRTHIRQKPYGCNQCGKSFCVKSKLIAHHRTHTGEKPYECNVCGKSFYVKSKLTVHQRIHLGRNPINVVNEGNYSG

SEQ ID NO: 943 - protein, 672 aa, Homo sapiens
  misc_feature (0)...(0): Polypeptide Accession Number P17252
MADVFPGNDSTASQDVANRFARKGALRQKNVHEVKDHKFIARFFKQPTFCSHCTDFIWGFGKQGFQCQVCCFVVHKRCHEFVTFSCPGADKGPDTDDPRSKHKFKIHTYGSPTFCDHCGSLLYGLIHQGMKCDTCDMNVHKQCVINVPSLCGMDHTEKRGRIYLKAEVADEKLHVTVRDAKNLIPMDPNGLSDPYVKLKLIPDPKNESKQKTKTIRSTLNPQWNESFTFKLKPSDKDRRLSVEIWDWDRTTRNDFMGSLSFGVSELMKMPASGWYKLLNQEEGEYYNVPIPEGDEEGNMELRQKFEKAKLGPAGNKVISPSEDRKQPSNNLDRVKLTDFNFLMVLGKGSFGKVMLADRKGTEELYAIKILKKDVVIQDDDVECTMVEKRVLALLDKPPFLTQLHSCFQTVDRLYFVMEYVNGGDLMYHIQQVGKFKEPQAVFYAAEISIGLFFLHKRGIIYRDLKLDNVMLDSEGHIKIADFGMCKEHMMDGVTTRTFCGTPDYIAPEIIAYQPYGKSVDWWAYGVLLYEMLAGQPPFDGEDEDELFQSIMEHNVSYPKSLSKEAVSICKGLMTKHPAKRLGCGPEGERDVREHAFFRRIDWEKLENREIQPPFKPKVCGKGAENFDKFFTRGQPVLTPPDQLVIANIDQSDFEGFSYVNPQFVHPILQSAV

SEQ ID NO: 944 - protein, 764 aa, Homo sapiens
  misc_feature (0)...(0): Polypeptide Accession Number P17480
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDATTKEVKDSLGKQWSQLSDKKRLKWIHKALEQRKEYEEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKSLSPQDRAAYKEYISNKRKSMTKLRGPNPKSSRTTLQSKSESEEDDEEDEDDEDEDEEEEDDENGDSSEDGGDSSESSSEDESEDGDENEEDDEDEDDDEDDDEDEDNESEGSSSSSSSSGDSSDSDSN

SEQ ID NO: 945 - protein, 705 aa, Homo sapiens [sequence omitted]

SEQ ID NO: 946 - protein, 350 aa, Homo sapiens
  misc_feature (0)...(0): Polypeptide Accession Number P17612
GNAAAAKKGSEQESVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 947 - protein, 700 aa, Homo sapiens
  misc_feature (0)...(0): Polypeptide Accession Number P17655
MAGIAAKLAKDREAAEGLGSHERAIKYLNQDYEALRNECLEAGTLFQDPSFPAIPSALGFKELGPYSSKTRGMRWKRPTEICADPQFIIGGATRTDICQGALGDCWLLAAIASLTLNEEILARVVPLNQSFQENYAGIFHFQFWQYGEWVEVVVDDRLPTKDGELLFVHSAEGSEFWSALLEKAYAKINGCYEALSGGATTEGFEDFTGGIAEWYELKKPPPNLFKIIQKALQKGSLLGCSIDITSAADSEAITFQKLVKGHAYSVTGAEEVESNGSLQKLIRIRNPWGEVEWTGRWNDNCPSWNTIDPEERERLTRRHEDGEFWMSFSDFLRHYSRLEICNLTPDTLTSDTYKKWKLTKMDGNWRRGSTAGGCRNYPNTFWMNPQYLIKLEEEDEDEEDGESGCTFLVGLIQKHRRRQRKMGEDMHTIGFGIYEVPEELSGQTNIHLSKNFFLTNRARERSDTFINLREVLNRFKLPPGEYILVPSTFEPNKDGDFCIRVFSEKKADYQAVDDEIEANLEEFDISEDDIDDGVRRLFAQLAGEDAEISAFELQTILRRVLAKRQDIKSDGFSIETCKIMVDMLDSDGSGKLGLKEFYILWTKIQKYQKIYREIDVDRSGTMNSYEMRKALEEAGFKMPCQLHQVIVARFADDQLIIDFDNFVRCLVRLETLFKIFKQLDPENTGTIELDLISWLCFSVL

SEQ ID NO: 948 - protein, 469 aa, Homo sapiens
  misc_feature (0)...(0): Polypeptide Accession Number P17661
SQAYSSSQRVSSYRRTFGGAPGFPLGSPLSSPVFPRAGFGSKGSSSSVTSRVYQVSRTSGGAGGLGSLRASRLGTTRTPSSYGAGELLDFSLADAVNQEFLTTRTNEKVELQELNDRFANYIEKVRFLEQQNAALAAEVNRLKGREPTRVAELYEEELRELRRQVEVLTNQRARVDVERDNLLDDLQRLKAKLQEEIQLKEEAENNLAAFRADVDAATLARIDLERRIESLNEEIAFLKKVHEEEIRELQAQLQEQQVQVEMDMSKPDLTAALRDIRAQYETIAAKNISEAEEWYKSKVSDLTQAANKNNDALRQAKQEMMEYRHQIQSYTCEIDALKGTNDSLMRQMRELEDRFASEASGYQDNIARLEEEIRHLKDEMARHLREYQDLLNVKMALDVEIATYRKLLEGEESRINLPIQTYSALNFRETSPEQRGSEVHTKKTVMIKTIETRDGEVVSEATQQQHEVL

SEQ ID NO: 949 - protein, 238 aa, Homo sapiens
  misc_feature (0)...(0): Polypeptide Accession Number P17677
MLCCMRRTKQVEKNDDDQKIEQDGIKPEDKAHKAATKIQASFRGHITRKKLKGEKKDDVQAAEAEANKKDEAPVADGVEKKGEGTTTAEAAPATGSKPDEPGKAGETPSEEKKGEGDAATEQAAPQAPASSEEKAGSAETESATKASTDNSPSSKAEDAPAKEEPKQADVPAAVTAAAATTPAAEDAAAKATAQPPTETGESSQAEENIEAVDETKPKESARQDEGKEEEPEADQEHA

SEQ ID NO: 950 - protein, 260 aa, Homo sapiens [sequence omitted]

SEQ ID NO: 951 - protein, 249 aa, Homo sapiens
  misc_feature (0)...(0): Polypeptide Accession Number P17931
ADNFSLHDALSGSGNPNPQGWPGAWGNQPAGAGGYPGASYPGAYPGQAPPGAYPGQAPPGAYHGAPGAYPGAPAPGVYPGPPSGPGAYPSSGQPSAPGAYPATGPYGAPAGPLIVPYNLPLPGGVVPRMLITILGTVKPNANRIALDFQRGNDVAFHFNPRFNENNRRVIVCNTKLDNNWGREERQSVFPFESGKPFKIQVLVEPDHFKVAVNDAHLLQYNHRVKKLNEISKLGISGDIDLTSASYTMI

SEQ ID NO: 952 - protein, 439 aa, Homo sapiens
  misc_feature (0)...(0): Polypeptide Accession Number P17980
MNLLPNIESPVTRQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALARGATELTHEDYMEGILEVQAKKKANLQYYA

SEQ ID NO: 953 - protein, 543 aa, Homo sapiens
  misc_feature (0)...(0): Polypeptide Accession Number P18146
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 954 - protein, 190 aa, Homo sapiens
  misc_feature (0)...(0): Polypeptide Accession Number P18283
MAFIAKSFYDLSAISLDGEKVDFNTFRGRAVLIENVRSLCGTTTRDFTQLNELQCRFPRRLVVLGFPCNQFGHQENCQNEEILNSLKYVRPGGGYQPTFTLVQKCEVNGQNEHPVFAYLKDKLPYPYDDPFSLMTDPKLIIWSPVRRSDVAWNFEKFLIGPEGEPFRRYSRTFPTINIEPDIKRLLKVAI

SEQ ID NO: 955 - protein, 1523 aa, Homo sapiens
  misc_feature (0)...(0): Polypeptide Accession Number P18583
MMSSYERSMMSYERSMMSPMAERSMMSAYERSMMSAYERSMMSPMAERSMMSAYERSMMSAYERSMMSPMADRSMMSMGADRSMMSSYSAADRSMMSSYSAADRSMMSSYTADRSMMSMAADSYTDSYTDTYTEAYMVPPLPPEEPPTMPPLPPEEPPMTPPLPPEEPPEGPALPTEQSALTAENTWPTEVPSLPSEESVSQPEPPVSQSEISEPSAVPTDYSVSASDPSVLVSEAAVTVPEPPPEPESSITLTPVESAVVAEEHEVVPERPVTCMVSETPAMSAEPTVLASEPPVMSETAETFDSMRASGHVASEVSTSLLVPAVTTPVLAESILEPPAMAAPESSAMAVLESSAVTVLESSTVTVLESSTVTVLEPSVVTVPEPPVVAEPDSVTIPVPVVSALEPSVPVLEPAVSVLQPSMIVSEPSVSVQESTVTVSEPAVTVSEQTQVIPTEVAIESTPMILESSIMSSHVMKGINLSSGDQILAPEIGMQEIALHSGEEPHAEEHLKGDFYESEHGINIDLNINSHLIAKEMEHNTVCAAGTSPVGEIGEEKILPTSETKQRTVLDTYPGVSEADAGETLSSTGPFALEPDATGTSKGIEFTTASTLSLVNKYDVDLSLTTQDTEHDMVIISTSPSGGSEADIEGPLPAKDIHLDLPSNNNLVSKDTEEPLPVKESDQTIAALLSPKESSGGEKEVPPPPKETLPDSGFSANIEDINEADLVRPLLPKDMERLTSLRAGIEGPLLASDVGRDRSAASPVVSSMPERASESSSEEKDDYEIFVKVKDTHEKSKKNKNRDKGEKEKKRDPHLRSRSKRSKSSEHKSRKRTSESRSRARKRSSKSKSHRSQTRSRSRSRRRRRSSRSRSKSRGRRSVSKEKRKRSPKHRSKSRERKRKRSSSRDNRKTVRARSRTPSRRSRSHTPSRRRRSRSVGRRRSFSISPSRRSRTPSRRSRTPSRRSRTPSRRSRTPSRRSRTPSRRSRTPSRRRRSRSVVRRRSFSISPVRLRRSRTPLRRRFSRSPIRRKRSRSSERGRSPKRLTDLDKAQLLEIAKANAAAMCAKAGVPLPPNLKPAPPPTIVEKVAKKSGGATIEELTEKCKQIAQSKEDDDVIVNKPHVSDEEEEEPPFYHHPFKLSEFKPIFFNLNIAAAKPTPPKSQVTLTKEFPVSSGSQHRKKEADSVYGEWVPVEKNGEENKDDDNVFSSNLPSEPVDISTAMSERALAQKRLSENAFDLEAMSMLNRAQERIDAWAQLNSIPGQFTGSTGVQVLTQEQLANTGAQAWIKKDQFLRAAPVTGGMGAVLMRKMGWREGEGLGKNKEGNKEPILVDFKTDRKGLVAVGERAQKRSGNFSAAMKDLSGKHPVSALMEICNKRRWQPPEFLLVHDSGPDHRKHFLFRVLINGSAYQPSFASPNKKHAKATAATVVLQAMGLVPKDLMANALASGVPHVDRLRFYNNHFRILLCITMYFLFNVVNIWQFKTLCKKQSVKTSPGFDFCTMEIVFNHTGFWYVYIVYLSDVFV

SEQ ID NO: 956 - protein, 1290 aa, Homo sapiens
  misc_feature (0)...(0): Polypeptide Accession Number P19174
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQQFLLDYQGELWAVDRLQVQEFMLSFLRDPLREIEEPYFFLDEFVTFLFSKENSVWNSQLDAVCPDTMNNPLSHYWISSSHNTYLTGDQFSSESSLEAYARCLRMGCRCIELDCWDGPDGMPVIYHGHTLTTKIKFSDVLHTIKEHAFVASEYPVILSIEDHCSIAQQRNMAQYFKKVLGDTLLTKPVEISADGLPSPNQLKRKILIKHKKLAEGSAYEEVPTSMMYSENDISNSIKNGILYLEDPVNHEWYPHYFVLTSSKIYYSEETSSDQGNEDEEEPKEVSSSTELHSNEKWFHGKLGAGRDGRHIAERLLTEYCIETGAPDGSFLVRESETFVGDYTLSFWRNGKVQHCRIHSRQDAGTPKFFLTDNLVFDSLYDLITHYQQVPLRCNEFEMRLSEPVPQTNAHESKEWYHASLTRAQAEHMLMRVPRDGAFLVRKRNEPNSYAISFRAEGKIKHCRVQQEGQTVMLGNSEFDSLVDLISYYEKHPLYRKMKLRYPINEEALEKIGTAEPDYGALYEGRNPGFYVEANPMPTFKCAVKALFDYKAQREDELTFIKSAIIQNVEKQEGGWWRGDYGGKKQLWFPSNYVEEMVNPVALEPEREHLDENSPLGDLLRGVLDVPACQIAIRPEGKNNRLFVFSISMASVAHWSLDVAADSQEELQDWVKKIREVAQTADARLTEGKIMERRKKIALELSELVVYCRPVPFDEEKIGTERACYRDMSSFPETKAEKYVNKAKGKKFLQYNRLQLSRIYPKGQRLDSSNYDPLPMWICGSQLVALNFQTPDKPMQMNQALFMTGRHCGYVLQPSTMRDEAFDPFDKSSLRGLEPCAISIEVLGARHLPKNGRGIVCPFVEIEVAGAEYDSTKQKTEFVVDNGLNPVWPAKPFHFQISNPEFAFLRFVVYEEDMFSDQNFLAQATFPVKGLKTGYRAVPLKNNYSEDLELASLLIKIDIFPAKENGDLSPFSGTSLRERGSDASGQLFHGRAREGSFESRYQQPFEDFRISQEHLADHFDSRERRAPRRTRVNGDNRL

SEQ ID NO: 957 - protein, 706 aa, Homo sapiens
  misc_feature (0)...(0): Polypeptide Accession Number P19338
VKLAKAGKNQGDPKKMAPPPKEVEEDSEDEEMSEDEEDDSSGEEVVIPQKKGKKAAATSAKKVVVSPTKKVAVATPAKKAAVTPGKKAAATPAKKTVTPAKAVTTPGKKGATPGKALVATPGKKGAAIPAKGAKNGKNAKKEDSDEEEDDDSEEDEEDDEDEDEDEDEIEPAAMKAAAAAPASEDEDDEDDEDDEDDDDDEEDDSEEEAMETTPAKGKKAAKVVPVKAKNVAEDEDEEEDDEDEDDDDDEDDEDDDDEDDEEEEEEEEEEPVKEAPGKRKKEMAKQKAAPEAKKQKVEGTEPTTAFNLFVGNLNFNKSAPELKTGISDVFAKNDLAVVDVRIGMTRKFGYVDFESAEDLEKALELTGLKVFGNEIKLEKPKGKDSKKERDARTLLAKNLPYKVTQDELKEVFEDAAEIRLVSKDGKSKGIAYIEFKTEADAEKTFEEKQGTEIDGRSISLYYTGEKGQNQDYRGGKNSTWSGESKTLVLSNLSYSATEETLQEVFEKATFIKVPQNQNGKSKGYAFIEFASFEDAKEALNSCNKREIEGRAIRLELQGPRGSPNARSQPSKTLFVKGLSEDTTEETLKESFDGSVRARIVTDRETGSSKGFGFVDFNSEEDAKEAMEDGEIDGNKVTLDWAKPKGEGGFGGRGGGRGGFGGRGGGRGGRGGFGGRGRGGFGGRGGFRGGRGGGGDHKPQGKKTKFE

SEQ ID NO: 958 - protein, 275 aa, Homo sapiens
  misc_feature (0)...(0): Polypeptide Accession Number P19387
MPYANQPTVRITELTDENVKFIIENTDLAVANSIRRVFIAEVPIIAIDWVQIDANSSVLHDEFIAHRLGLIPLISDDIVDKLQYSRDCTCEEFCPECSVEFTLDVRCNEDQTRHVTSRDLISNSPRVIPVTSRNRDNDPNDYVEQDDILIVKLRKGQELRLRAYAKKGFGKEHAKWNPTAGVAFEYDPDNALRHTVYPKPEEWPKSEYSELDEDESQAPYDPNGKPERFYYNVESCGSLRPETIVLSALSGLKKKLSDLQTQLSHEIQSDVLTIN

SEQ ID NO: 959 - protein, 210 aa, Homo sapiens
  misc_feature (0)...(0): Polypeptide Accession Number P19388
MDDEEETYRLWKIRKTIMQLCHDRGYLVTQDELDQTLEEFKAQFGDKPSEGRPRRTDLTVLVAHNDDPTDQMFVFFPEEPKVGIKTIKVYCQRMQEENITRALIVVQQGMTPSAKQSLVDMAPKYILEQFLEQELLINITEHELVPEHVVMTKEEVTELLARYKLRENQLPRIQAGDPVARYFGIKRGQVVKIIRPSETAGRYITYRLVQ

SEQ ID NO: 960 - protein, 449 aa, Homo sapiens
  misc_feature (0)...(0): Polypeptide Accession Number P19544
MGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 961 - protein, 350 aa, Homo sapiens
  misc_feature (0)...(0): Polypeptide Accession Number P19784
MPGPAAGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRREPFFHGQDNYDQLVRIAKVLGTEELYGYLKKYHIDLDPHFNDILGQHSRKRWENFIHSENRHLVSPEALDLLDKLLRYDHQQRLTAKEAMEHPYFYPVVKEQSQPCADNAVLSSGLTAAR

SEQ ID NO: 962 - protein, 526 aa, Homo sapiens
  misc_feature (0)...(0): Polypeptide Accession Number P19878
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVLYNIAFMYAKKEEWKKAEEQLALATSMKSEPRHSKIDKAMECVWKQKLYEPVVIPVGKLFRPNERQVAQLAKKDYLGKATVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVGDQGFPDEPKESEKADANNQTTEPQLKKGSQVEALFSYEATQPEDLEFQEGDIILVLSKVNEEWLEGECKGKVGIFPKVFVEDCATTDLESTRREV

SEQ ID NO: 963 - protein, 435 aa, Homo sapiens
  misc_feature (0)...(0): Polypeptide Accession Number P20172
MIGGLFIYNHKGEVLISRVYRDDIGRNAVDAFRVNVIHARQQVRSPVTNIARTSFFHVKRSNIWLAAVTKQNVNAAMVFEFLYKMCDVMAAYFGKISEENIKNNFVLIYELLDEILDFGYPQNSETGALKTFITQQGIKSQHQTKEEQSQITSQVTGQIGWRREGIKYRRNELFLDVLESVNLLMSPQGQVLSAHVSGRVVMKSYLSGMPECKFGMNDKIVIEKQGKGTADETSKSGKQSIAIDDCTFHQCVRLSKFDSERSISFIPPDGEFELMRYRTTKDIILPFRVIPLVREVGRTKLEVKVVIKSNFKPSLLAQKIEVRIPTPLNTSGVQVICMKGKAKYKASENAIVWKIKRMAGMKESQISAEIELLPTNDKKKWARPPISMNFEVPFAPSGLKVRYLKVFEPKLNYSDHDVIKWVRYIGRSGIYETRC

SEQ ID NO: 964 - protein, 339 aa, Homo sapiens
  misc_feature (0)...(0): Polypeptide Accession Number P20226
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIFVSGKVVLTGAKVRAEIYEAFENIYPILKGFRKTT

SEQ ID NO: 965 - protein, 432 aa, Homo sapiens
  misc_feature (0)...(0): Polypeptide Accession Number P20248
MLGNSAPGPATREAGSALLALQQTALQEDQENINPEKAAPVQQPRTRAALAVLKSGNPRGLAQQQRPKTRRVAPLKDLPVNDEHVTVPPWKANSKQPAFTIHVDEAEKEAQKKPAESQKIEREDALAFNSAISLPGPRKPLVPLDYPMDGSFESPHTMDMSIVLEDEKPVSVNEVPDYHEDIHTYLREMEVKCKPKVGYMKKQPDITNSMRAILVDWLVEVGEEYKLQNETLHLAVNYIDRFLSSMSVLRGKLQLVGTAAMLLASKFEEIYPPEVAEFVYITDDTYTKKQVLRMEHLVLKVLTFDLAAPTVNQFLTQYFLHQQPANCKVESLAMFLGELSLIDADPYLKYLPSVIAGAAFHLALYTVTGQSWPESLIRKTGYTLESLKPCLMDLHQTYLKAPQHAQQSIREKYKNSKYHGVSLLNPPETLNL

SEQ ID NO: 966 - protein, 443 aa, Homo sapiens
  misc_feature (0)...(0): Polypeptide Accession Number P20265
MATAASNHYSLLTSSASIVHAEPPGAMQQGAGGYREAQSLVQGDYGALQSNGHPLSHAHQWITALSHGGGGGGGGGGGGGGGGGGGGGDGSPWSTSPLGQPDIKPSVVVQQGGRGDELHGPGALQQQHQQQQQQQQQQQQQQQQQQQQQRPPHLVHHAANHHPGPGAWRTAAAAAHLPPSMGASNGGLLYSQPSFTVNGMLGAGGQPAGLHHHGLRDAHDEPHHADHHPHPHSHPHQQPPPPPPPQGPPGHPGAHHDPHSDEDTPTSDDLEQFAKQFKQRRIKLGFTQADVGLALGTLYGNVFSQTTICRFEALQLSFKNMCKLKPLLNKWLEEADSSSGSPTSIDKIAAQGRKRKKRTSIEVSVKGALESHFLKCPKPSAQEITSLADSLQLEKEVVRVWFCNRRQKEKRMTPPGGTLPGAEDVYGGSRDTPPHHGVQTPVQ

SEQ ID NO: 967 - protein, 590 aa, Homo sapiens
  misc_feature (0)...(0): Polypeptide Accession Number P20309
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLSLACADLIIGVISMNLFTTYIIMNRWALGNLACDLWLAIDYVASNASVMNLLVISFDRYFSITRPLTYRAKRTTKRAGVMIGLAWVISFVLWAPAILFWQYFVGKRTVPPGECFIQFLSEPTITFGTAIAAFYMPVTIMTILYWRIYKETEKRTKELAGLQASGTEAETENFVHPTGSSRSCSSYELQQQSMKRSNRRKYGRCHFWFTTKSWKPSSEQMDQDHSSSDSWNNNDAAASLENSASSDEEDIGSETRAIYSIVLKLPGHSTILNSTKLPSSDNLQVPEEELGMVDLERKADKLQAQKSVDDGGSFPKSFSKLPIQLESAVDTAKTSDVNSSVGKSTATLPLSFKEATLAKRFALKTRSQITKRKRMSLVKEKKAAQTLSAILLAFIITWTPYNIMVLVNTFCDSCIPKTFWNLGYWLCYINSTVNPVCYALCNKTFRTTFKMLLLCQCDKKKRRKQQYQQRQSVIFHKRAPEQAL

SEQ ID NO: 968 - protein, 1137 aa, Homo sapiens
  misc_feature (0)...(0): Polypeptide Accession Number P20585
MSRRKPASGGLAASSSAPARQAVLSRFFQSTGSLKSTSSSTGAADQVDPGAAAAAAAAAAAAPPAPPAPAFPPQLPPHVATEIDRRKKRPLENDGPVKKKVKKVQQKEGGSDLGMSGNSEPKKCLRTRNVSKSLEKLKEFCCDSALPQSRVQTESLQERFAVLPKCTDFDDISLLHAKNAVSSEDSKRQINQKDTTLFDLSQFGSSNTSHENLQKTASKSANKRSKSIYTPLELQYIEMKQQHKDAVLCVECGYKYRFFGEDAEIAARELNIYCHLDHNFMTASIPTHRLFVHVRRLVAKGYKVGVVKQTETAALKAIGDNRSSLFSRKLTALYTKSTLIGEDVNPLIKLDDAVNVDEIMTDTSTSYLLCISENKENVRDKKKGNIFIGIVGVQPATGEVVFDSFQDSASRSELETRMSSLQPVELLLPSALSEQTEALIHRATSVSVQDDRIRVERMDNIYFEYSHAFQAVTEFYAKDTVDIKGSQIISGIVNLEKPVICSLAAIIKYLKEFNLEKMLSKPENFKQLSSKMEFMTINGTTLRNLEILQNQTDMKTKGSLLWVLDHTKTSFGRRKLKKWVTQPLLKLREINARLDAVSEVLHSESSVFGQIENHLRKLPDIGRGLCSIYHKKCSTQEFFLIVKTLYHLKSEFQAIIPAVNSHIQSDLLRTVILEIPELLSPVEHYLKILNEQAAKVGDKTELFKDLSDFPLIKKRKDEIQGVIDEIRMHLQEIRKILKNPSAQYVTVSGQEFMIEIKNSAVSCIPTDWVKVGSTKAVSRFHSPFIVENYRHLNQLREQLVLDCSAEWLDFLEKFSEHYHSLCKAVHHLATVDCIFSLAKVAKQGDYCRPTVQEERKIVIKNGRHPVIDVLLGEQDQYVPNNTDLSEDSERVMIITGPNMGGKSSYIKQVALITIMAQIGSYVPAEEATIGIVDGIFTRMGAADNIYKGRSTFMEELTDTAEIIRKATSQSLVILDELGRGTSTHDGIAIAYATLEYFIRDVKSLTLFVTHYPPVCELEKNYSHQVGNYHMGFLVSEDESKLDPGTAEQVPDFVTFLYQITRGIAARSYGLNVAKLADVPGEILKKAAHKSKELEGLINTKRKRLKYFAKLWTMHNAQDLQKWTEEFNMEETQTSLLH

SEQ ID NO: 969 - protein, 661 aa, Homo sapiens
  misc_feature (0)...(0): Polypeptide Accession Number P20591
VVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTLIKKYIQRQETISLVVVPSNVDIATTEALSMAQEVDPEGDRTIGILTKPDLVDKGTEDKVVDVVRNLVFHLKKGYMIVKCRGQQEIQDQLSLSEALQREKIFFENHPYFRDLLEEGKATVPCLAEKLTSELITHICKSLPLLENQIKETHQRITEELQKYGVDIPEDENEKMFFLIDKINAFNQDITALMQGEETVGEEDIRLFTRLRHEFHKWSTIIENNFQEGHKILSRKIQKFENQYRGRELPGFVNYRTFETIVKQQIKALEEPAVDMLHTVTDMVRLAFTDVSIKNFEEFFNLHRTAKSKIEDIRAEQEREGEKLIRLHFQMEQIVYCQDQVYRGALQKVREKELEEEKKKKSWDFGAFQSSSATDSSMEEIFQHLMAYHQEASKRISSHIPLIIQFFMLQTYGQQLQKAMLQLLQDKDTYSWLLKERSDTSDKRKFLKERLARLTQARRRLAQFPG

SEQ ID NO: 970 - protein, 715 aa, Homo sapiens
  misc_feature (0)...(0): Polypeptide Accession Number P20592
MSKAHKPWPYRRRSQFSSRKYLKKEMNSFQQQPPPFGTVPPQMMFPPNWQGAEKDAAFLAKDFNFLTLNNQPPPGNRSQPRAMGPENNLYSQYEQKVRPCIDLIDSLRALGVEQDLALPAIAVIGDQSSGKSSVLEALSGVALPRGSGIVTRCPLVLKLKKQPCEAWAGRISYRNTELELQDPGQVEKEIHKAQNVMAGNGRGISHELISLEITSPEVPDLTIIDLPGITRVAVDNQPRDIGLQIKALIKKYIQRQQTINLVVVPCNVDIATTEALSMAHEVDPEGDRTIGILTKPDLMDRGTEKSVMNVVRNLTYPLKKGYMIVKCRGQQEITNRLSLAEATKKEITFFQTHPYFRVLLEEGSATVPRLAERLTTELIMHIQKSLPLLEGQIRESHQKATEELRRCGADIPSQEADKMFFLIEKIKMFNQDIEKLVEGEEVVRENETRLYNKIREDFKNWVGILATNTQKVKNIIHEEVEKYEKQYRGKELLGFVNYKTFEIIVHQYIQQLVEPALSMLQKAMEIIQQAFINVAKKHFGEFFNLNQTVQSTIEDIKVKHTAKAENMIQLQFRMEQMVFCQDQIYSVVLKKVREEIFNPLGTPSQNMKLNSHFPSNESSVSSFTEIGIHLNAYFLETSKRLANQIPFIIQYFMLRENGDSLQKAMMQILQEKNRYSWLLQEQSETATKRRILKERIYRLTQARHALCQFSSKEIH

SEQ ID NO: 971 - protein, 446 aa, Homo sapiens
  misc_feature (0)...(0): Polypeptide Accession Number P20749
MDEGPVDLRTRPKAAGLPGAALPLRKRPLRAPSPEPAAPRGAAGLVVPLDPLRGGCDLPAVPGPPHGLARPEALYYPGALLPLYPTRAMGSPFPLVNLPTPLYPMMCPMEHPLSADIAMATRADEDGDTPLHIAVVQGNLPAVHRLVNLFQQGGRELDIYNNLRQTPLHLAVITTLPSVVRLLVTAGASPMALDRHGQTAAHLACEHRSPTCLRALLDSAAPGTLDLEARNYDGLTALHVAVNTECQETVQLLLERGADIDAVDIKSGRSPLIHAVENNSLSMVQLLLQHGANVNAQMYSGSSALHSASGRGLLPLVRTLVRSGADSSLKNCHNDTPLMVARSRRVIDILRGKATRPASTSQPDPSPDRSANTSPESSSRLSSNGLLSASPSSSPSQSPPRDPPGFPMAPPNFFLPSPSPPAFLPFAGVLRGPGRPVPPSPAPGGS

SEQ ID NO: 972 - protein, 821 aa, Homo sapiens
  misc_feature (0)...(0): Polypeptide Accession Number P20807
MPTVISASVAPRTAAEPRSPGPVPHPAQSKATEAGGGNPSGIYSAIISRNFPIIGVKEKTFEQLHKKCLEKKVLYVDPEFPPDETSLFYSQKFPIQFVWKRPPEICENPRFIIDGANRTDICQGELGDCWFLAAIACLTLNQHLLFRVIPHDQSFIENYAGIFHFQFWRYGEWVDVVIDDCLPTYNNQLVFTKSNHRNEFWSALLEKAYAKLHGSYEALKGGNTTEAMEDFTGGVAEFFEIRDAPSDMYKIMKKAIERGSLMGCSIDDGTNMTYGTSPSGLNMGELIARMVRNMDNSLLQDSDLDPRGSDERPTRTIIPVQYETRMACGLVRGHAYSVTGLDEVPFKGEKVKLVRLRNPWGQVEWNGSWSDRWKDWSFVDKDEKARLQHQVTEDGEFWMSYEDFIYHFTKLEICNLTADALQSDKLQTWTVSVNEGRWVRGCSAGGCRNFPDTFWTNPQYRLKLLEEDDDPDDSEVICSFLVALMQKNRRKDRKLGASLFTIGFAIYEVPKEMHGNKQHLQKDFFLYNASKARSKTYINMREVSQRFRLPPSEYVIVPSTYEPHQEGEFILRVFSEKRNLSEEVENTISVDRPVKKKKTKPIIFVSDRANSNKELGVDQESEEGKGKTSPDKQKQSPQPQPGSSDQESEEQQQFRNIFKQIAGDDMEICADELKKVLNTVVNKHKDLKTHGFTLESCRSMIALMDTDGSGKLNLQEFHHLWNKIKAWQKIFKHYDTDQSGTINSYEMRNAVNDAGFHLNNQLYDIITMRYADKHMNIDFDSFICCFVRLEGMFRAFHAFDKDGDGIIKLNVLEWLQLTMYA

SEQ ID NO: 973 - protein, 514 aa, Homo sapiens
  misc_feature (0)...(0): Polypeptide Accession Number P20839
MADYLISGGTGYVPEDGLTAQQLFASADDLTYNDFLILPGFIDFIADEVDLTSALTRKITLKTPLISSPMDTVTEADMAIAMALMGGIGFIHHNCTPEFQANEVRKVKNFEQGFITDPVVLSPSHTVGDVLEAKMRHGFSGIPITETGTMGSKLVGIVTSRDIDFLAEKDHTTLLSEVMTPRIELVVAPAGVTLKEANEILQRSKKGKLPIVNDCDELVAIIARTDLKKNRDYPLASKDSQKQLLCGAAVGTREDDKYRLDLLTQAGVDVIVLDSSQGNSVYQIAMVHYIKQKYPHLQVIGGNVVTAAQAKNLIDAGVDGLRVGMGCGSICITQEVMACGRPQGTAVYKVAEYARRFGVPIIADGGIQTVGHVVKALALGASTVMMGSLLAATTEAPGEYFFSDGVRLKKYRGMGSLDAMEKSSSSQKRYFSEGDKVKIAQGVSGSIQDKGSIQKFVPYLIAGIQHGCQDIGARSLSVLRSMMYSGELKFEKRTMSAQIEGGVHGLHSYEKRLY

SEQ ID NO: 974 - protein, 317 aa, Homo sapiens
  misc_feature (0)...(0): Polypeptide Accession Number P21108
PNIKIFSGSSHQDLSQKIADRLGLELGKVVTKKFSNQETCVEIDESVRGEDVYIVQSGCGEINDSLMELLIMINACKIASASRVTAVIPCFPYARQDKKDKSRSPISAKLVANMLSIAGADHIITMDLHASQIQGFFDIPVDNLYAEPTVLKWIRENIPEWKNCIIVSPDAGGAKRVTSIADQLNVDFALIHKERKKANEVDCIVLVGDVNDRVAILVDDMADTCVTICLAADKLLSAGATRVYAILTHGIFSGPAISRINTACFEAVVVTNTIPQDEKMKHCSKIRVIDISMILAEAIRRTHNGESVSYLFSHVPL

SEQ ID NO: 975 - protein, 191 aa, Homo sapiens
  misc_feature (0)...(0): Polypeptide Accession Number P21181
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQRGLKNVFDEAILAALEPPETQPKRKCCIF

SEQ ID NO: 976 - protein, 1279 aa, Homo sapiens
  misc_feature (0)...(0): Polypeptide Accession Number P21439
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 977 - protein, 348 aa, Homo sapiens
  misc_feature (0)...(0): Polypeptide Accession Number P21695
ASKKVCIVGSGNWGSAIAKIVGGNAAQLAQFDPRVTMWVFEEDIGGKKLTEIINTQHENVKYLPGHKLPPNVVAVPDVVQAAEDADILIFVVPHQFIGKICDQLKGHLKANPTGISLIKGVDEGPNGLKLISEVIGERLGIPMSVLMGANIASEVADEKFCETTIGCKDPAQGQLLKELMQTPNFRITVVQEVDTVEICGALKNVVAVGAGFCDGLGFGDNTKAAVIRLGLMEMIAFAKLFCSGPVSSATFLESCGVADLITTCYGGRNRKVAEAFARTGKSIEQLEKELLNGQKLQGPETARELYSILQHKGLVDKFPLFMAVYKVCYEGQPVGEFIHCLQNHPEHM

SEQ ID NO: 978 - protein, 317 aa, Homo sapiens
  misc_feature (0)...(0): Polypeptide Accession Number P21815
MKTALILLSILGMACAFSMKNLHRRVKIEDSEENGVFKYRPRYYLYKHAYFYPHLKRFPVQGSSDSSEENGDDSSEEEEEEEETSNEGENNEESNEDEDSEAENTTLSATTLGYGEDATPGTGYTGLAAIQLPKKAGDITNKATKEKESDEEEEEEEEGNENEESEAEVDENEQGINGTSTNSTEAENGNGSSGVDNGEEGEEESVTGANAEGTTETGGQGKGTSKTTTSPNGGFEPTTPPQVYRTTSPPFGKTTTVEYEGEYEYTGANDYDNGYEIYESENGEPRGDNYRAYEDEYSYFKGQGYDGYDGQNYYHHQ

SEQ ID NO: 979 - protein, 5032 aa, Homo sapiens [sequence omitted]

SEQ ID NO: 980 - protein, 937 aa, Homo sapiens
  misc_feature (0)...(0): Polypeptide Accession Number P21851
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 981 - protein, 392 aa, Homo sapiens
  misc_feature (0)...(0): Polypeptide Accession Number P21953
MAVVAAAAGWLLRLRAAGAEGHWRRLPGAGLARGFLHPAATVEDAAQRRQVAHFTFQPDPEPREYGQTQKMNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKVVIPRSPFQAKGLLLSCIEDKNPCIFFEPKILYRAAAEEVPIEPYNIPLSQAEVIQEGSDVTLVAWGTQVHVIREVASMAKEKLGVSCEVIDLRTIIPWDVDTICKSVIKTGRLLISHEAPLTGGFASEISSTVQEECFLNLEAPISRVCGYDTPFPHIFEPFYIPDKWKCYDALRKMINY

SEQ ID NO: 982 - protein, 1010 aa, Homo sapiens
  misc_feature (0)...(0): Polypeptide Accession Number P22102
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQVSNDLLLKIKDTVLQRTVDGMQQEGTPYTGILYAGIMLTKNGPKVLEFNCRFGDPECQVILPLLKSDLYEVIQSTLDGLLCTSLPVWLENHTALTVVMASKGYPGDYTKGVEITGFPEAQALGLEVFHAGTALKNGKVVTHGGRVLAVTAIRENLISALEEAKKGLAAIKFEGAIYRKDVGFRAIAFLQQPRSLTYKESGVDIAAGNMLVKKIQPLAKATSRSGCKVDLGGFAGLFDLKAAGFKDPLLASGTDGVGTKLKIAQLCNKHDTIGQDLVAMCVNDILAQGAEPLFFLDYFSCGKLDLSVTEAVVAGIAKACGKAGCALLGGETAEMPDMYPPGEYDLAGFAVGAMERDQKLPHLERITEGDVVVGIASSGLHSNGFSLVRKIVAKSSLQYSSPAPDGCGDQTLGDLLLTPTRIYSHSLLPVLRSGHVKAFAHITGGGLLENIPRVLPEKLGVDLDAQTWRIPRVFSWLQQEGHLSEEEMARTFNCGVGAVLVVSKEQTEQILRDIQQHKEEAWVIGSVVARAEGSPRVKVKNLIESMQINGSVLKNGSLTNHFSFEKKKARVAVLISGTGSNLQALIDSTREPNSSAQIDIVISNKAAVAGLDKAERAGIPTRVINHKLYKNRVEFDSAIDLVLEEFSIDIVCLAGFMRILSGPFVQKWNGKMLNIHPSLLPSFKGSNAHEQALETGVTVTGCTVHFVAEDVDAGQIILQEAVPVKRGDTVATLSERVKLAEHKIFPAALQLVASGTVQLGENGKICWVKEE

SEQ ID NO: 983 - protein, 425 aa, Homo sapiens
  misc_feature (0)...(0): Polypeptide Accession Number P22234
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISLKQADKKIRECNL

SEQ ID NO: 984 - protein, 547 aa, Homo sapiens
  misc_feature (0)...(0): Polypeptide Accession Number P22307
MSSSPWEPATLRRVFVVGVGMTKFVKPGAENSRDYPDLAEEAGKKALADAQIPYSAVDQACVGYVFGDSTCGQRAIYHSLGMTGIPIINVNNNCATGSTALFMARQLIQGGVAECVLALGFEKMSKGSLGIKFSDRTIPTDKHVDLLINKYGLSAHPVAPQMFGYAGKEHMEKYGTKIEHFAKIGWKNHKHSVNNPYSQFQDEYSLDEVMASKEVFDFLTILQCCPTSDGAAAAILASEAFVQKYGLQSKAVEILAQEMMTDLPSSFEEKSIIKMVGFDMSKEAARKCYEKSGLTPNDIDVIELHDCFSTNELLTYEALGLCPEGQGATLVDRGDNTYGGKWVINPSGGLISKGHPLGATGLAQCAELCWQLRGEAGKRQVPGAKVALQHNLGIGGAVVVTLYKMGFPEAASSFRTHQIEAVPTSSASDGFKANLVFKEIEKKLEEEGEQFVKKIGGIFAFKVKDGPGGKEATWVVDVKNGKGSVLPNSDKKADCTITMADSDFLALMTGKMNPQSAFFQGKLKITGNMGLAMKLQNLQLQPGNAKL

SEQ ID NO: 985 - protein, 1058 aa, Homo sapiens
  misc_feature (0)...(0): Polypeptide Accession Number P22314
MSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRGIKLVVAGTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPQDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSQGVSMLYSFFMPAAKLKERLDQPMTEIVSRVSKRKLGRHVRALVLELCCNDESGEDVEVPYVRYTIR

SEQ ID NO: 986 - protein, 226 aa, Homo sapiens
  misc_feature (0)...(0): Polypeptide Accession Number P22352
MARLLQASCLLSLLLAGFVSQSRGQEKSKMDCHGGISGTIYEYGALTIDGEEYIPFKQYAGKYVLFVNVASYCGLTGQYIELNALQEELAPFGLVILGFPCNQFGKQEPGENSEILPTLKYVRPGGGFVPNFQLFEKGDVNGEKEQKFYTFLKNSCPPTSELLGTSDRLFWEPMKVHDIRWNFEKFLVGPDGIPIMRWHHRTTVSNVKMDILSYMRRQAALGVKRK

SEQ ID NO: 987 - protein, 152 aa, Homo sapiens
  misc_feature (0)...(0): Polypeptide Accession Number P22392
MANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 988 - protein, 491 aa, Homo sapiens
  misc_feature (0)...(0): Polypeptide Accession Number P22570
MASRCWRWWGWSAWPRTRLPPAGSTPSFCHHFSTQEKTPQICVVGSGPAGFYTAQHLLKHPQAHVDIYEKQPVPFGLVRFGVAPDHPEVKNVINTFTQTAHSGRCAFWGNVEVGRDVTVPELQEAYHAVVLSYGAEDHRALEIPGEELPGVCSARAFVGWYNGLPENQELEPDLSCDTAVILGQGNVALDVARILLTPPEHLERTDITKAALGVLRQSRVKTVWLVGRRGPLQVAFTIKELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVKRGPTGVIATTMTDSFLTGQMLLQDLKAGLLPSGPRPGYAAIQALLSSRGVRPVSFSDWEKLDAEEVARGQGTGKPREKLVDPQEMLRLLGH

SEQ ID NO: 989 - protein, 353 aa, Homo sapiens
  misc_feature (0)...(0): Polypeptide Accession Number P22626
MEKTLETVPLERKKREKEQFRKLFIGGLSFETTEESLRNYYEQWGKLTDCVVMRDPASKRSRGFGFVTFSSMAEVDAAMAARPHSIDGRVVEPKRAVAREESGKPGAHVTVKKLFVGGIKEDTEEHHLRDYFEEYGKIDTIEIITDRQSGKKRGFGFVTFDDHDPVDKIVLQKYHTINGHNAEVRKALSRQEMQEVQSSRSGRGGNFGFGDSRGGGGNFGPGPGSNFRGGSDGYGSGRGFGDGYNGYGGGPGGGNFGGSPGYGGGRGGYGGGGPGYGNQGGGYGGGYDNYGGGNYGSGNYNDFGNYNQQPSNYGPMKSGNFGGSRNMGGPYGGGNYGPGGSGGSGGYGGRSRY

SEQ ID NO: 990 - protein, 979 aa, Homo sapiens
  misc_feature (0)...(0): Polypeptide Accession Number P22670
MATQAYTELQAAPPPSQPPQAPPQAQPQPPPPPPPAAPQPPQPPTAAATPQPQYVTELQSPQPQAQPPGGQKQYVTELPAVPAPSQPTGAPTPSPAPQQYIVVTVSEGAMRASETVSEASPGSTASQTGVPTQVVQQVQGTQQRLLVQTSVQAKPGHVSPLQLTNIQVPQQALPTQRLVVQSAAPGSKGGQVSLTVHGTQQVHSPPEQSPVQANSSSSKTAGAPTGTVPQQLQVHGVQQSVPVTQERSVVQATPQAPKPGPVQPLTVQGLQPVHVAQEVQQLQQVPVPHVYSSQVQYVEGGDASYTASAIRSSTYSYPETPLYTQTASTSYYEAAGTATQVSTPATSQAVASSGSMPMYVSGSQVVASSASTGAGASNSSGGGGSGGGGGGGGGGGGGGSGSTGGGGSGAGTYVIQGGYMLGSASQSYSHTTRASPATVQWLLDNYETAEGVSLPRSTLYCHYLLHCQEQKLEPVNAASFGKLIRSVFMGLRTRRLGTRGNSKYHYYGLRIKASSPLLRLMEDQQHMAMRGQPFSQKQRLKPIQKMEGMTNGVAVGQQPSTGLSDISAQVQQYQQFLDASRSLPDFTELDLQGKVLPEGVGPGDIKAFQVLYREHCEAIVDVMVNLQFTLVETLWKTFWRYNLSQPSEAPPLAVHDEAEKRLPKAILVLLSKFEPVLQWTKHCDNVLYQGLVEILIPDVLRPIPSALTQAIRNFAKSLESWLTHAMVNIPEEMLRVKVAAAGAFAQTLRRYTSLNHLAQAARAVLQNTAQINQMLSDLNRVDFANVQEQASWVCRCEDRVVQRLEQDFKVTLQQQNSLEQWAAWLDGVVSQVLKPYQGSAGFPKAAKLFLLKWSFYSSMVIRDLTLRSAASFGSFHLIRLLYDEYMYYLIEHRVAQAKGETPIAVMGEFANLATSLNPLDPDKDEEEEEEEESEDELPQDISLAAGGESPALGPETLEPPAKLARTDARGLFVQALPSS

SEQ ID NO: 991 - protein, 350 aa, Homo sapiens
  misc_feature (0)...(0): Polypeptide Accession Number P22694
GNAATAKKGSEVESVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 992 - protein, 536 aa, Homo sapiens
  misc_feature (0)...(0): Polypeptide Accession Number P22792
QPMGCDCFVQEVFCSDEELATVPLDIPPYTKNIIFVETSFTTLETRAFGSNPNLTKVVFLDTQLCQFRPDAFGGLPRLEDLEVTGSSFLNLSTNIFSNLTSLGKLTLNFNMLEALPEGLFQHLAALESLHLQGNQLQALPRRLFQPLTHLKTLNLAQNLLAQLPEELFHPLTSLQTLKLSNNALSGLPQGVFGKLGSLQELFLDSNNISELPPQVFSQLFCLERLWLQRNAITHLPLSIFASLGNLTFLSLQWNMLRVLPAGLFAHTPCLVGLSLTHNQLETVTEGTFAHLSNLRSLMLSYNAITHLPAGIFRDLEELVKLYLGSNNLTALHPALFQNLSKLELLSLSKNQLTTLPEASSTPTTTCSTWPCTVTPGSATAPGLPLQLAAAVHRSAPEHPDLLRCPAYLKGQVVHALNEKQLVSVTRDHLGFQVTWPDESKAGGSWDLAVQERAARSQCTYSNPEGTVVLACDQAQCRWLNVQLSPRQGSLGLQYNASQEWDLRRAAVLCGSPCLSRLGQQGPSSSHTGAGEGGLWG

SEQ ID NO: 993 - protein, 707 aa, Homo sapiens
  misc_feature (0)...(0): Polypeptide Accession Number P23246
MSRDRFRSRGGGGGGFHRRGGGGGRGGLHDFRSPPPGMGLNQNRGPMGPGPGQSGPKPPIPPPPPHQQQQQPPPQQPPPQQPPPHQPPPHPQPHQQQQPPPPPQDSSKPVVAQGPGPAPGVGSAPPASSSAPPATPPTSGAPPGSGPGPTPTPPPAVTSAPPGAPPPTPPSSGVPTTPPQAGGPPPPPAAVPGPGPGPKQGPGPGGPKGGKMPGGPKPGGGPGLSTPGGHPKPPHRGGGEPRGGRQHHPPYHQQHHQGPPPGGPGGRSEEKISDSEGFKANLSLLRRPGEKTYTQRCRLFVGNLPADITEDEFKRLFAKYGEPGEVFINKGKGFGFIKLESRALAEIAKAELDDTPMRGRQLRVRFATHAAALSVRNLSPYVSNELLEEAFSQFGPIERAVVIVDDRGRSTGKGIVEFASKPAARKAFERCSEGVFLLTTTPRPVIVEPLEQLDDEDGLPEKLAQKNPMYQKERETPPRFAQHGTFEYEYSQRWKSLDEMEKQQREQVEKNMKDAKDKLESEMEDAYHEHQANLLRQDLMRRQEELRRMEELHNQEMQKRKEMQLRQEEERRRREEEMMIRQREMEEQMRRQREESYSRMGYMDPRERDMRMGGGGAMNMGDPYGSGGQKFPPLGGGGGIGYEANPGVPPATMSGSMMGSDMRTERFGQGGAGPVGGQGPRGMGPGTPAGYGRGREEYEGPNKKPRF

SEQ ID NO: 994 - protein, 208 aa, Homo sapiens
  misc_feature (0)...(0): Polypeptide Accession Number P23284
MKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 995 - protein, 699 aa, Homo sapiens
  misc_feature (0)...(0): Polypeptide Accession Number P23327
MGHHRPWLHASVLWAGVASLLLPPAMTQQLRGDGLGFRNRNNSTGVAGLSEEASAELRHHLHSPRDHPDENKDVSTENGHHFWSHPDREKEDEDVSKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQHCQFCYLCPLVCETVCAPGSYVDYFSSSLYQALADMLETPEP

SEQ ID NO: 996 - protein, 502 aa, Homo sapiens
  misc_feature (0)...(0): Polypeptide Accession Number P23443
MAGVFDIDLDQPEDAGSEDELEEGGQLNESMDHGGVGPYELGMEHCEKFEISETSVNRGPEKIRPECFELLRVLGKGGYGKVFQVRKVTGANTGKIFAMKVLKKAMIVRNAKDTAHTKAERNILEEVKHPFIVDLIYAFQTGGKLYLILEYLSGGELFMQLEREGIFMEDTACFYLAEISMALGHLHQKGIIYRDLKPENIMLNHQGHVKLTDFGLCKESIHDGTVTHTFCGTIEYMAPEILMRSGHNRAVDWWSLGALMYDMLTGAPPFTGENRKKTIDKILKCKLNLPPYLTQEARDLLKKLLKRNAASRLGAGPGDAGEVQAHPFFRHINWEELLARKVEPPFKPLLQSEEDVSQFDSKFTRQTPVDSPDDSTLSESANQVFLGFTYVAPSVLESVKEKFSFEPKIRSPRRFIGSPRTPVSPVKFSPGDFWGRGASASTANPQTPVEYPMETSGIEQMDVTMSGEASAPLPIRQPNSGPYKKQAFPMISKRPEHLRMNL

SEQ ID NO: 997 - protein, 316 aa, Homo sapiens
  misc_feature (0)...(0): Polypeptide Accession Number P23490
MSYQKKQPTPQPPVDCVKTSGGGGGGGGTGGGGCGFFGGGGSGGGSSGSGCGYSGGGGYSGGGCGGGSSGGGGGGGIGGCGGGSGGSVKYSGGGGSSGGGSGCFSSGGGGSGCFSSGGGGSSGGGSGCFSSGGGGSSGGGSGCFSSGGGGFSGQAVQCQSYGGVSSGGSSGGGSGCFSSGGGGGSVCGYSGGGSGGGSGCGGGSSGGSGSGYVSSQQVTQTSCAPQPSYGGGSSGGGGSGGSGCFSSGGGGGSSGCGGGSSGIGSGCIISGGGSVCGGGSSGGGGGGSSVGGSGSGKGVPICHQTQQKQAPTWPSK

SEQ ID NO: 998 - protein, 347 aa, Homo sapiens
  misc_feature (0)...(0): Polypeptide Accession Number P23511
MEQYTANSNSSTEQIVVQAGQIQQQQQGGVTAVQLQTEAQVASASGQQVQTLQVVQGQPLMVQVSGGQLITSTGQPIMVQAVPGGQGQTIMQVPVSGTQGLQQIQLVPPGQIQIQGGQAVQVQGQQGQTQQIIIQQPQTAVTAGQTQTQQQIAVQGQQVAQTAEGQTIVYQPVNADGTILQQVTVPVSGMITIPAASLAGAQIVQTGANTNTTSSGQGTVTVTLPVAGNVVNSGGMVMMVPGAGSVPAIQRIPLPGAEMLEEEPLYVNAKQYHRILKRRQARAKLEAEGKIPKERRKYLHESRHRHAMARKRGEGGRFFSPKEKDSPHMQDPNQADEEAMTQIIRVS

SEQ ID NO: 999 - protein, 440 aa, Homo sapiens
  misc_feature (0)...(0): Polypeptide Accession Number P23515
MEYQILKMSLCLFILLFLTPGILCICPLQCICTERHRHVDCSGRNLSTLPSGLQENIIHLNLSYNHFTDLHNQLTQYTNLRTLDISNNRLESLPAHLPRSLWNMSAANNNIKLLDKSDTAYQWNLKYLDVSKNMLEKVVLIKNTLRSLEVLNLSSNKLWTVPTNMPSKLHIVDLSNNSLTQILPGTLINLTNLTHLYLHNNKFTFIPDQSFDQLFQLQEITLYNNRWSCDHKQNITYLLKWMMETKAHVIGTPCSTQISSLKEHNMYPTPSGFTSSLFTVSGMQTVDTINSLSVVTQPKVTKIPKQYRTKETTFGATLSKDTTFTSTDKAFVPYPEDTSTETINSHEAAAATLTIHLQDGMVTNTSLTSSTKSSPTPMTLSITSGMPNNFSEMPQQSTTLNLWREETTTNVKTPLPSVANAWKVNASFLLLLNVVVMLAV

SEQ ID NO: 1000 - protein, 152 aa, Homo sapiens
  misc_feature (0)...(0): Polypeptide Accession Number P23567
MSTPARRRLMRDFKRLQEDPPVGVSGAPSENNIMQWNAVIFGPEGTPFEDGTFKLVIEFSEEYPNKPPTVRFLSKMFHPNVYADGSICLDILQNRWSPTYDVSSILTSIQSLLDEPNPNSPANSQAAQLYQENKREYEKRVSAIVEQSWNDS

SEQ ID NO: 1001 - protein, 480 aa, Homo sapiens
  misc_feature (0)...(0): Polypeptide Accession Number P23769
MEVAPEQPGWMAHPAVLNAHDPDSHHPGLAHNYMEPAHVLPPDEVDVFFNHLDSQGNPYYANPAHARAAVSYSPAHARLTGSQMCRPHLLHSPGLPWLDGGKAALSAAAAHHHNPWTVSPFSKTPLHPSAAGGPGGPLSVYPGAGGGSGGGSGSSVASLTPTAAHSGSHLFGFPPTPPKEVSPDPSTTGAASPASSSAGGSAARGEDKDGVKYQVSLTESMKMESGSPLRPGLATMGTQPATHHPIPTYPSYVPAAAHDYSSGLFHPGGFLGGPASSFTPKQRSKARSCSEGRECVNCGATATPLWRRDGTGHYLCNACGLYHKMNGQNRPLIKPKRRLSAARRAGTCCANCQTTTTTLWRRNANGDPVCNACGLYYKLHNVNRPLTMKKEGIQTRNRKMSNKSKKSKKGAECFEELSKCMQEKSSPFSAAALAGHMAPVGHLPPFSHSGHILPTPTPIHPSSSLSFGHPHPSSMVTAMG

SEQ ID NO: 1002 - protein, 443 aa, Homo sapiens
  misc_feature (0)...(0): Polypeptide Accession Number P23771
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKARSSTGRECVNCGATSTPLWRRDGTGHYLCNACGLYHKMNGQNRPLIKPKRRLSAARRAGTSCANCQTTTTTLWRRNANGDPVCNACGLYYKLHNINRPLTMKKEGIQTRNRKMSSKSKKCKKVHDSLEDFPKNSSFNPAALSRHMSSLSHISPFSHSSHMLTTPTPMHPPSSLSFGPHHPSSMVTAMG

SEQ ID NO: 1003 - protein, 682 aa, Homo sapiens
  misc_feature (0)...(0): Polypeptide Accession Number P24723
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDFVANCTLQFQELVGTTGASDTFEGWVDLEPEGKVFVVITLTGSFTEATLQRDRIFKHFTRKRQRAMRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILLDDDVECTMTEKRILSLARNHPFLTQLFCCFQTPDRLFFVMEFVNGGDLMFHIQKSRRFDEARARFYAAEIISALMFLHDKGIIYRDLKLDNVLLDHEGHCKLADFGMCKEGICNGVTTATFCGTPDYIAPEILQEMLYGPAVDWWAMGVLLYEMLCGHAPFEAENEDDLFEAILNDEVVYPTWLHEDATGILKSFMTKNPTMRLGSLTQGGEHAILRHPFFKEIDWAQLNHRQIEPPFRPRIKSREDVSNFDPDFIKEEPVLTPIDEGHLPMINQDEFRNFSYVSPELQP

SEQ ID NO: 1004 - protein, 427 aa, Homo sapiens
  misc_feature (0)...(0): Polypeptide Accession Number P24752
MAVLAALLRSGARSRSPLLRRLVQEIRYVERSYVSKPTLKEVVIVSATRTPIGSFLGSLSLLPATKLGSIAIQGAIEKAGIPKEEVKEAYMGNVLQGGEGQAPTRQAVLGAGLPISTPCTTINKVCASGMKAIMMASQSLMCGHQDVMVAGGMESMSNVPYVMNRGSTPYGGVKLEDLIVKDGLTDVYNKIHMGSCAENTAKKLNIARNEQDAYAINSYTRSKAAWEAGKFGNEVIPVTVTVKGQPDVVVKEDEEYKRVDFSKVPKLKTVFQKENGTVTAANASTLNDGAAALVLMTADAAKRLNVTPLARIVAFADAAVEPIDFPIAPVYAASMVLKDVGLKKEDIAMWEVNEAFSLVVLANIKMLEIDPQKVNINGGAVSLGHPIGMSGARIVGHLTHALKQGEYGLASICNGGGGASAMLIQKL

SEQ ID NO: 1005 - protein, 1970 aa, Homo sapiens
  misc_feature (0)...(0): Polypeptide Accession Number P24928
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPTSPKYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

SEQ ID NO: 1006 - protein, 298 aa, Homo sapiens
  misc_feature (0)...(0): Polypeptide Accession Number P24941
MENFQKVEKIGEGTYGVVYKARNKLTGEVVALKKIRLDTETEGVPSTAIREISLLKELNHPNIVKLLDVIHTENKLYLVFEFLHQDLKKFMDASALTGIPLPLIKSYLFQLLQGLAFCHSHRVLHRDLKPQNLLINTEGAIKLADFGLARAFGVPVRTYTHEVVTLWYRAPEILLGCKYYSTAVDIWSLGCIFAEMVTRRALFPGDSEIDQLFRIFRTLGTPDEVVWPGVTSMPDYKPSFPKWARQDFSKVVPPLDEDGRSLLSQMLHYDPNKRISAKAALAHPFFQDVTKPVPHLRL

SEQ ID NO: 1007 - protein, 2843 aa, Homo sapiens
  misc_feature (0)...(0): Polypeptide Accession Number P25054
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIAEIKEKIGTRSAEDPVSEVPAVSQHPRTKSSRLQGSSLSSESARHKAVEFSSGAKSPSKSGAQTPKSPPEHYVQETPLMFSRCTSVSSLDSFESRSIASSVQSEPCSGMVSGIISPSDLPDSPGQTMPPSRSKTPPPPPQTAQTKREVPKNKAPTAEKRESGPKQAAVNAAVQRVQVLPDADTLLHFATESTPDGFSCSSSLSALSLDEPFIQKDVELRIMPPVQENDNGNETESEQPKESNENQEKEAEKTIDSEKDLLDDSDDDDIEILEECIISAMPTKSSRKAKKPAQTASKLPPPVARKPSQLPVYKLLPSQNRLQPQKHVSFTPGDDMPRVYCVEGTPINFSTATSLSDLTIESPPNELAAGEGVRGGAQSGEFEKRDTIPTEGRSTDEAQGGKTSSVTIPELDDNKAEEGDILAECINSAMPKGKSHKPFRVKKIMDQVQQASASSSAPNKNQLDGKKKKPTSPVKPIPQNTEYRTRVRKNADSKNNLNAERVFSDNKDSKKQNLKNNSKDFNDKLPNNEDRVRGSFAFDSPHHYTPIEGTPYCFSRNDSLSSLDFDDDDVDLSREKAELRKAKENKESEAKVTSHTELTSNQQSANKTQAIAKQPINRGQPKPILQKQSTFPQSSKDIPDRGAATDEKLQNFAIENTPVCFSHNSSLSSLSDIDQENNNKENEPIKETEPPDSQGEPSKPQASGYAPKSFHVEDTPVCFSRNSSLSSLSIDSEDDLLQECISSAMPKKKKPSRLKGDNEKHSPRNMGGILGEDLTLDLKDIQRPDSEHGLSPDSENFDWKAIQEGANSIVSSLHQAAAAACLSRQASSDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 1008 - protein, 207 aa, Homo sapiens
  misc_feature (0)...(0): Polypeptide Accession Number P25208
MTMDGDSSTTDASQLGISADYIGGSHYVIQPHDDTEDSMNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVTATDGLSEELTEEAFTNQLPAGLITTDGQQQNVMVYTTSYQQISGVQQIQFS

SEQ ID NO: 1009 - protein, 317 aa, Homo sapiens [sequence omitted]

SEQ ID NO: 1010 - protein, 191 aa, Homo sapiens
  misc_feature (0)...(0): Polypeptide Accession Number P25763
MQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKGLKNVFDEAILAALEPPEPKKSRRCVLL

SEQ ID NO: 1011 - protein, 263 aa, Homo sapiens
  misc_feature (0)...(0): Polypeptide Accession Number P25786
MFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 1012 - protein, 233 aa, Homo sapiens
  misc_feature (0)...(0): Polypeptide Accession Number P25787
AERGYSFSLTTFSPSGKLVQIEYALAAVAGGAPSVGIKAANGVVLATEKKQKSILYDERSVHKVEPITKHIGLVYSGMGPDYRVLVHRARKLAQQYYLVYQEPIPTAQLVQRVASVMQEYTQSGGVRPFGVSLLICGWNEGRPYLFQSDPSGAYFAWKATAMGKNYVNGKTFLEKRYNEDLELEDAIHTAILTLKESFEGQMTEDNIEVGICNEAGFRRLTPTEVKDYLAAIA

SEQ ID NO: 1013 - protein, 254 aa, Homo sapiens
  misc_feature (0)...(0): Polypeptide Accession Number P25788
SSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 1014 - protein, 261 aa, Homo sapiens
  misc_feature (0)...(0): Polypeptide Accession Number P25789
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEKVEIATLTRENGKTVIRVLKQKEVEQLIKKHEEEEAKAEREKKEKEQKEKDK

SEQ ID NO: 1015 - protein, 483 aa, Homo sapiens
  misc_feature (0)...(0): Polypeptide Accession Number P26196
MSTARTENPVIMGLSSQNGQLRGPVKPTGGPGGGGTQTQQQMNQLKNTNTINNGTQQQAQSMTTTIKPGDDWKKTLKLPPKDLRIKTSDVTSTKGNEFEDYCLKRELLMGIFEMGWEKPSPIQEESIPIALSGRDILARAKNGTGKSGAYLIPLLERLDLKKDNIQAMVIVPTRELALQVSQICIQVSKHMGGAKVMATTGGTNLRDDIMRLDDTVHVVIATPGRILDLIKKGVAKVDHVQMIVLDEADKLLSQDFVQIMEDIILTLPKNRQILLYSATFPLSVQKFMNSHLEKPYEINLMEELTLKGVTQYYAYVTERQKVHCLNTLFSRLQINQSIIFCNSSQRVELLAKKISQLGYSCFYIHAKMRQEHRNRVFHDFRNGLCRNLVCTDLFTRGIDIQAVNVVINFDFPKLAETYLHRIGRSGRFGHLGLAINLITYDDRFNLKSIEEQLGTEIKPIPSNIDKSLYVAEYHSEPVEDEKP

SEQ ID NO: 1016 - protein, 1616 aa, Homo sapiens
  misc_feature (0)...(0): Polypeptide Accession Number P26358
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKPEPSPSPRITRKSTRQTTITSHFAKGPAKRKPQEESERAKSDESIKEEDKDQDEKRRRVTSRERVARPLPAEEPERAKSGTRTEKEEERDEKEEKRLRSQTKEPTPKQKLKEEPDREARAGVQADEDEDGDEKDEKKHRSQPKDLAAKRRPEEKEPEKVNPQISDEKDEDEKEEKRRKTTPKEPTEKKMARAKTVMNSKTHPPKCIQCGQYLDDPDLKYGQHPPDAVDEPQMLTNEKLSIFDANESGFESYEALPQHKLTCFSVYCKHGHLCPIDTGLIEKNIELFFSGSAKPIYDDDPSLEGGVNGKNLGPINEWWITGFDGGEKALIGFSTSFAEYILMDPSPEYAPIFGLMQEKIYISKIVVEFLQSNSDSTYEDLINKIETTVPPSGLNLNRFTEDSLLRHAQFVVEQVESYDEAGDSDEQPIFLTPCMRDLIKLAGVTLGQRRAQARRQTIRHSTREKDRGPTKATTTKLVYQIFDTFFAEQIEKDDREDKENAFKRRRCGVCEVCQQPECGKCKACKDMVKFGGSGRSKQACQERRCPNMAMKEADDDEEVDDNIPEMPSPKKMHQGKKKKQNKNRISWVGEAVKTDGKKSYYKKVCIDAETLEVGDCVSVIPDDSSKPLYLARVTALWEDSSNGQMFHAHWFCAGTDTVLGATSDPLELFLVDECEDMQLSYIHSKVKVIYKAPSENWAMEGGMDPESLLEGDDGKTYFYQLWYDQDYARFESPPKTQPTEDNKFKFCVSCARLAEMRQKEIPRVLEQLEDLDSRVLYYSATKNGILYRVGDGVYLPPEAFTFNIKLSSPVKRPRKEPVDEDLYPEHYRKYSDYIKGSNLDAPEPYRIGRIKEIFCPKKSNGRPNETDIKIRVNKFYRPENTHKSTPASYHADINLLYWSDEEAVVDFKAVQGRCTVEYGEDLPECVQVYSMGGPNRFYFLEAYNAKSKSFEDPPNHARSPGNKGKGKGKGKGKPKSQACEPSEPEIEIKLPKLRTLDVFSGCGGLSEGFHQAGISDTLWAIEMWDPAAQAFRLNNPGSTVFTEDCNILLKLVMAGETTNSRGQRLPQKGDVEMLCGGPPCQGFSGMNRFNSRTYSKFKNSLVVSFLSYCDYYRPRFFLLENVRNFVSFKRSMVLKLTLRCLVRMGYQCTFGVLQAGQYGVAQTRRRAIILAAAPGEKLPLFPEPLHVFAPRACQLSVVVDDKKFVSNITRLSSGPFRTITVRDTMSDLPEVRNGASALEISYNGEPQSWFQRQLRGAQYQPILRDHICKDMSALVAARMRHIPLAPGSDWRDLPNIEVRLSDGTMARKLRYTHHDRKNGRSSSGALRGVCSCVEAGKACDPAARQFNTLIPWCLPHTGNRHNHWAGLYGRLEWDGFFSTTVTNPEPMGKQGRVLHPEQHRVVSVRECARSQGFPDTYRLFGNILDKHRQVGNAVPPPLAKAIGLEIKLCMLAKARESASAKIKEEEAAKD

SEQ ID NO: 1017 - protein, 380 aa, Homo sapiens
  misc_feature (0)...(0): Polypeptide Accession Number P26378
MVMIISTMEPQVSNGPTSNTSNGPSSNNRNCPSPMQTGATTDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGATEPITVKFANNPSQKSSQALLSQLYQSPNRRYPGPLHHQAQRFRLDNLLNMAYGVKRLMSGPVPPSACSPRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKAHKS

SEQ ID NO: 1018 - protein, 208 aa, Homo sapiens
  misc_feature (0)...(0): Polypeptide Accession Number P26583
GKGDPNKPRGKMSSYAFFVQTCREEHKKKHPDSSVNFAEFSKKCSERWKTMSAKEKSKFEDMAKSDKARYDREMKNYVPPKGDKKGKKKDPNAPKRPPSAFFLFCSEHRPKIKSEHPGLSIGDTAKKLGEMWSEQSAKDKQPYEQKAAKLKEKYEKDIAAYRAKGKSEAGKKGPGRPTGSKKKNEPEDEEEEEEEEDEDEEEEDEDEE

SEQ ID NO: 1019 - protein, 326 aa, Homo sapiens
  misc_feature (0)...(0): Polypeptide Accession Number P26651
MDLTAIYESLLSLSPDVPVPSDHGGTESSPGWGSSGPWSLSPSDSSPSGVTSRLPGRSTSLVEGRSCGWVPPPPGFAPLAPRLGPELSPSPTSPTATSTTPSRYKTELCRTFSESGRCRYGAKCQFAHGLGELRQANRHPKYKTELCHKFYLQGRCPYGSRCHFIHNPSEDLAAPGHPPVLRQSISFSGLPSGRRTSPPPPGLAGPSLSSSSFSPSSSPPPPGDLPLSPSAFSAAPGTPLARRDPTPVCCPSCRRATPISVWGPLGGLVRTPSVQSLGSDPDEYASSGSSLGGSDSPVFEAGVFAPPQPVAAPRRLPIFNRISVSE

SEQ ID NO: 1020 - protein, 141 aa, Homo sapiens
  misc_feature (0)...(0): Polypeptide Accession Number P26885
MRLSWFRVLTVLSICLSAVASTGTEGKRKLQIGVKKRVDHCPIKSRKGDVLHMHYTGKLEDGTEFDSSLPQNQPFVFSLGTGQVIKGWDQGLLGMYEGEKRKLVIPSELGYGERGAPPKIPGGATLVFEVELLKIERRTEL

SEQ ID NO: 1021 - protein, 379 aa, Homo sapiens
  misc_feature (0)...(0): Polypeptide Accession Number P27361
MAAAAAQGGGGGEPRRTEGVGPGVPGEVEMVKGQPFDVGPRYTQLQYIGEGAYGMVSSAYDHVRKTRVAIKKISPFEHQTYCQRTLREIQILLRFRHENVIGIRDILRASTLEAMRDVYIVQDLMETDLYKLLKSQQLSNDHICYFLYQILRGLKYIHSANVLHRDLKPSNLLINTTCDLKICDFGLARIADPEHDHTGFLTEYVATRWYRAPEIMLNSKGYTKSIDIWSVGCILAEMLSNRPIFPGKHYLDQLNHILGILGSPSQEDLNCIINMKARNYLQSLPSKTKVAWAKLFPKSDSKALDLLDRMLTFNPNKRITVEEALAHPYLEQYYDPTDEPVAEEPFTFAMELDDLPKERLKELIFQETARFQPGVLEAP

SEQ ID NO: 1022 - protein, 713 aa, Homo sapiens
  misc_feature (0)...(0): Polypeptide Accession Number P27448
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETQKTLYLIMEYASGGKVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSEVRPSSDLNNSTGQSPHHKVQRSVSSSQKQRRYSDHAGPGIPSVVAYPKRSQTSTADSDLKEDGISSRKSTGSAVGGKGIAPASPMLGNASNPNKADIPERKKSSTVPSSNTASGGMTRRNTYVCSERTTDDRHSVIQNGKENSTIPDQRTPVASTHSISSAATPDRIRFPRGTASRSTFHGQPRERRTATYNGPPASPSLSHEATPLSQTRSRGSTTLFSKLTSKLTRSRNVSAKQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 1023 - protein, 417 aa, Homo sapiens
  misc_feature (0)...(0): Polypeptide Accession Number P27797
MLLSVPLLLGLLGLAVAEPAVYFKEQFLDGDGWTSRWIESKHKSDFGKFVLSSGKFYGDEEKDKGLQTSQDARFYALSASFEPFSNKGQTLVVQFTVKHEQNIDCGGGYVKLFPNSLDQTDMHGDSEYNIMFGPDICGPGTKKVHVIFNYKGKNVLINKDIRCKDDEFTHLYTLIVRPDNTYEVKIDNSQVESGSLEDDWDFLPPKKIKDPDASKPEDWDERAKIDDPTDSKPEDWDKPEHIPDPDAKKPEDWDEEMDGEWEPPVIQNPEYKGEWKPRQIDNPDYKGTWIHPEIDNPEYSPDPSIYAYDNFGVLGLDLWQVKSGTIFDNFLITNDEAYAEEFGNETWGVTKAAEKQMKDKQDEEQRLKEEEEDKKRKEEEEAEDKEDDEDKDEDEEDEEDKEEDEEEDVPGQAKDEL

SEQ ID NO: 1024 - protein, 592 aa, Homo sapiens
  misc_feature (0)...(0): Polypeptide Accession Number P27824
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 1025 - protein, 129 aa, Homo sapiens
  misc_feature (0)...(0): Polypeptide Accession Number P28001
SGRGKQGGKARAKAKTRSSRAGLQFPVGRVHRLLRKGNYSERVGAGAPVYLAAVLEYLTAEILELAGNAARDNKKTRIIPRHLQLAIRNDEELNKLLGRVTIAQGGVLPNIQAVLLPKKTESHHKAKGK

SEQ ID NO: 1026 - protein, 803 aa, Homo sapiens
  misc_feature (0)...(0): Polypeptide Accession Number P28160
MDVAIEFCLEEWQCLDIAQQNLYRNVMLENYRNLVFLGIAVSKPDLITCLEQEKEPWEPMRRHEMVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCMLPHLAQHKIIHTRVNFCKCEKCGKAFNCPSIITKHKRINTGEKPYTCEECGKVFNWSSRLTTHKKNYTRYKLYKCEECGKAFNKSSILTTHKIIRTGEKFYKCKECAKAFNQSSNLTEHKKIHPGEKPYKCEECGKAFNWPSTLTKHKRIHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKCEECGKAFNHFSILTKHKRIHTGEKPYKCEECGKAFTQSSNLTTHKKIHTGEKFYKCEECGKAFTQSSNLTTHKKIHTGGKPYKCEECGKAFNQFSTLTKHKIIHTEEKPYKCEECGKAFKWSSTLTKHKIIHTGEKPYKCEECGKAFKLSSTLSTHKIIHTGEKPYKCEKCGKAFNRPSNLIEHKKIHTGEQPYKCEECGKAFNYSSHLNTHKRIHTKEQPYKCKECGKAFNQYSNLTTHNKIHTGEKLYKPEDVTVILTTPQTFSNIK

SEQ ID NO: 1027 - protein, 976 aa, Homo sapiens [sequence omitted]

SEQ ID NO: 1028 - protein, 360 aa, Homo sapiens [sequence omitted]

SEQ ID NO: 1029 - protein, 217 aa, Homo sapiens
  misc_feature (0)...(0): Polypeptide Accession Number P28676
MAYPGYGGGFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDFLQGTMAI

SEQ ID NO: 1030 - protein, 291 aa, Homo sapiens
  misc_feature (0)...(0): Polypeptide Accession Number P29084
MDPSLLRERELFKKRALSTPVVEKRSASSESSSSSSKKKKTKVEHGGSSGSKQNSDHSNGSFNLKALSGSSGYKFGVLAKIVNYMKTRHQRGDTHPLTLDEILDETQHLDIGLKQKQWLMTEALVNNPKIEVIDGKYAFKPKYNVRDKKALLRLLDQHDQRGLGGILLEDIEEALPNSQKAVKALGDQILFVNRPDKKKILFFNDKSCQFSVDEEFQKLWRSVTVDSMDEEKIEEYLKRQGISSMQESGPKKVAPIQRRKKPASQKKRRFKTHNEHLAGVLKDYSDITSSK

SEQ ID NO: 1031 - protein, 1249 aa, Homo sapiens
  misc_feature (0)...(0): Polypeptide Accession Number P29144
MATAATEEPFPFHGLLPKKETGAASFLCRYPEYDGRGVLIAVLDTGVDPGAPGMQVTTDGKPKIVDIIDTTGSGDVNTATEVEPKDGEIVGLSGRVLKIPASWTNPSGKYHIGIKNGYDFYPKALKERIQKERKEKIWDPVHRVALAEACRKQEEFDVANNGSSQANKLIKEELQSQVELLNSFEKKYSDPGPVYDCLVWHDGEVWRACIDSNEDGDLSKSTVLRNYKEAQEYGSFGTAEMLNYSVNIYDDRNLLSIVTSGGAHGTHVASIAAGHFPEEPERNGVAPGAQILSIKIGDTRLSTMETGTGLIRAMIEVINHKCDLVNYSYGEATHWPNSGRICEVINEAVWKHNIIYVSSAGNNGPCLSTVGCPGGTTSSVIGVGAYVSPDMMVAEYSLREKLPANQYTWSSRGPSADGALGVSISAPGGAIASVPNWTLRGTQLMNGTSMSSPNACGGIALILSGLKANNIDYTVHSVRRALENTAVKADNIEVFAQGHGIIQVDKAYDYLVQNTSFANKLGFTVTVGNNRGIYLRDPVQVAAPSDHGVGIEPVFPENTENSEKISLQLHLALTSNSSWVQCPSHLELMNQCRHINIRVDPRGLREGLHYTEVCGYDIASPNAGPLFRVPITAVIAAKVNESSHYDLAFTDVHFKPGQIRRHFIEVPEGATWAEVTVCSCSSEVSAKFVLHAVQLVKQRAYRSHEFYKFCSLPEKGTLTEAFPVLGGKAIEFCIARWWASLSDVNIDYTISFHGIVCTAPQLNIHASEGINRFDVQSSLKYEDLAPCITLKNWVQTLRPVSAKTKPLGSRDVLPNNRQLYEMVLTYNFHQPKSGEVTPSCPLLCELLYESEFDSQLWIIFDQNKRQMGSGDAYPHQYSLKLEKGDYTIRLQIRHEQISDLERLKDLPFIVSHRLSNTLSLDIHENHSFALLGKKKSSNLTLPPKYNQPFFVTSLPDDKIPKGAGPGCYLAGSLTLSKTELGKKADVIPVHYYLIPPPTKTKNGSKDKEKDSEKEKDLKEEFTEALRDLKIQWMTKLDSSDIYNELKETYPNYLPLYVARLHQLDAEKERMKRLNEIVDAANAVISHIDQTALAVYIAMKTDPRPDAATIKNDMDKQKSTLVDALCRKGCALADHLLHTQAQDGAISTDAEGKEEEGESPLDSLAETFWETTKWTDLFDNKVLTFAYKHALVNKMYGRGLKFATKLVEEKPTKENWKNCIQLMKLLGWTHCASFTENWLPIMYPPDYCVF

SEQ ID NO: 1032 - protein, 217 aa, Homo sapiens [sequence omitted]

SEQ ID NO: 1033 - protein, 1722 aa, Homo sapiens
  misc_feature (0)...(0): Polypeptide Accession Number P29375
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRRKKVKELIEKEKEKDLDLEPLSDLEEGLEETRDTAMVVAVFKEREQKEIEAMHSLRAANLAKMTMVDRIEEVKFCICRKTASGFMLQCELCKDWFHNSCVPLPKSSSQKKGSSWQAKEVKFLCPLCMRSRRPRLETILSLLVSLQKLPVRLPEGEALQCLTERAMSWQDRARQALATDELSSALAKLSVLSQRMVEQAAREKTEKIISAELQKAAANPDLQGHLPSFQQSAFNRVVSSVSSSPRQTMDYDDEETDSDEDIRETYGYDMKDTASVKSSSSLEPNLFCDEEIPIKSEEVVTHMWTAPSFCAEHAYSSASKSCSQVFFGKGSSTPRKQPRKSPLVPRSLEPPVLELSPGAKAQLEELMMVGDLLEVSLDETQHIWRILQATHPPSEDRFLHIMEDDSMEEKPLKVKGKDSSEKKRKRKLEKVEQLFGEGKQKSKELKKMDKPRKKKLKLGADKSKKLNKLAKKLAKEEERKKKKEKAAAAKVELVKESTEKKREKKVLDIPSKYDWSGAEESDDENAVCAEPDCQRPCKDKGVVFVTKKREIKNISFKSVLCDCFSKKVDWVQCDGGCDEWFHRVCVGVSPEMAENEDYICINCAKKQGPVSPGPAPPPSFIMSYKLPMEDLKETS

SEQ ID NO: 1034 - protein, 1434 aa, Homo sapiens
  misc_feature (0)...(0): Polypeptide Accession Number P29475
MEDHMFGVQQIQPNVISVRLFKRKVGGLGFLVKERVSKPPVIISDLIRGGAAEQSGLIQAGDIILAVNGRPLVDLSYDSALEVLRGIASETHVVLILRGPEGFTTHLETTFTGDGTPKTIRVTQPLGPPTKAVDLSHQPPAGKEQPLAVDGASGPGNGPQHAYDDGQEAGSLPHANGLAPRPPGQDPAKKATRVSLQGRGENNELLKEIEPVLSLLTSGSRGVKGGAPAKAEMKDMGIQVDRDLDGKSHKPLPLGVENDRVFNDLWGKGNVPVVLNNPYSEKEQPPTSGKQSPTKNGSPSKCPRFLKVKNWETEVVLTDTLHLKSTLETGCTEYICMGSIMHPSQHARRPEDVRTKGQLFPLAKEFIDQYYSSIKRFGSKAHMERLEEVNKEIDTTSTYQLKDTELIYGAKHAWRNASRCVGRIQWSKLQVFDARDCTTAHGMFNYICNHVKYATNKGNLRSAITIFPQRTDGKHDFRVWNSQLIRYAGYKQPDGSTLGDPANVQFTEICIQQGWKPPRGRFDVLPLLLQANGNDPELFQIPPELVLEVPIRHPKFEWFKDLGLKWYGLPAVSNMLLEIGGLEFSACPFSGWYMGTEIGVRDYCDNSRYNILEEVAKKMNLDMRKTSSLWKDQALVEINIAVLYSFQSDKVTIVDHHSATESFIKHMENEYRCRGGCPADWVWIVPPMSGSITPVFHQEMLNYRLTPSFEYQPDPWNTHVWKGTNGTPTKRRAIGFKKLAEAVKFSAKLMGQAMAKRVKATILYATETGKSQAYAKTLCEIFKHAFDAKVMSMEEYDIVHLEHETLVLVVTSTFGNGDPPENGEKFGCALMEMRHPNSVQEERKSYKVRFNSVSSYSDSQKSSGDGPDLRDNFESAGPLANVRFSVFGLGSRAYPHFCAFGHAVDTLLEELGGERILKMREGDELCGQEEAFRTWAKKVFKAACDVFCVGDDVNIEKANNSLISNDRSWKRNKFRLTFVAEAPELTQGLSNVHKKRVSAARLLSRQNLQSPKSSRSTIFVRLHTNGSQELQYQPGDHLGVFPGNHEDLVNALIERLEDAPPVNQMVKVELLEERNTALGVISNWTDELRLPPCTIFQAFKYYLDITTPPTPLQLQQFASLATSEKEKQRLLVLSKGLQEYEEWKWGKNPTIVEVLEEFPSIQMPATLLLTQLSLLQPRYYSISSSPDMYPDEVHLTVAIVSYRTRDGEGPIHHGVCSSWLNRIQADELVPCFVRGAPSFHLPRNPQVPCILVGPGTGIAPFRSFWQQRQFDIQHKGMNPCPMVLVFGCRQSKIDHIYREETLQAKNKGVFRELYTAYSREPDKPKKYVQDILQEQLAESVYRALKEQGGHIYVCGDVTMAADVLKAIQRIMTQQGKLSAEDAGVFISRMRDDNRYHEDIFGVTLRTYEVTNRLRSESIAFIEESKKDTDEVFSS

SEQ ID NO: 1035 - protein, 372 aa, Homo sapiens [sequence omitted]

SEQ ID NO: 1036 - protein, 882 aa, Homo sapiens
  misc_feature (0)...(0): Polypeptide Accession Number P29590
  misc_feature (0)...(0): Polypeptide Accession Number P29591
  misc_feature (0)...(0): Polypeptide Accession Number P29592
  misc_feature (0)...(0): Polypeptide Accession Number P29593
  misc_feature (0)...(0): Polypeptide Accession Number Q00755
MEPAPARSPRPQQDPARPQEPTMPPPETPSEGRQPSPSPSPTERAPASEEEFQFLRCQQCQAEAKCPKLLPCLHTLCSGCLEASGMQCPICQAPWPLGADTPALDNVFFESLQRRLSVYRQIVDAQAVCTRCKESADFWCFECEQLLCAKCFEAHQWFLKHEARPLAELRNQSVREFLDGTRKTNNIFCSNPNHRTPTLTSIYCRGCSKPLCCSCALLDSSHSELKCDISAEIQQRQEELDAMTQALQEQDSAFGAVHAQMHAAVGQLGRARAETEELIRERVRQVVAHVRAQERELLEAVDARYQRDYEEMASRLGRLDAVLQRIRTGSALVQRMKCYASDQEVLDMHGFLRQALCRLRQEEPQSLQAAVRTDGFDEFKVRLQDLSSCITQGKDAAVSKKASPEAASTPRDPIDVDLPEEAERVKAQVQALGLAEAQPMAVVQSVPGAHPVPVYAFSIKGPSYGEDVSNTTTAQKRKCSQTQCPRKVIKMESEEGKEARLARSSPEQPRPSTSKAVSPPHLDGPPSPRSPVIGSEVFLPNSNHVASGAGEAEERVVVISSSEDSDAENSSSRELDDSSSESSDLQLEGPSTLRVLDENLADPQAEDRPLVFFDLKIDNETQKISQLAAVNRESKFRVVIQPEALFSIYSKAVSLEVGLQHFLSFLSSMRRPILACYKLWGPGLPNFFRALEDINRLWEFQEAISGFLAALPLIRERVPGASSFKLKNLAQTYLARNMSERSAMAAVLAMRDLCRLLEVSPGPQLAQHVYPFSSLQCFASLQPLVQAAVLPRAEARLLALHNVSFMELLSAHRRDRQGGLKKYSRYLSLQTTTLPPAQPAFNLQALGTYFEGLLEGPALARAEGVSTPLAGRGLAERASQQS

SEQ ID NO: 1037 - protein, 686 aa, Homo sapiens
  misc_feature (0)...(0): Polypeptide Accession Number P29973
MKNNIINTQQSFVTMPNVIVPDIEKEIRRMENGACSSFSEDDDSASTSEESENENPHARGSFSYKSLRKGGPSQREQYLPGAIALFNVNNSSNKDQEPEEKKKKKKEKKSKSDDKNENKNDPEKKKKKKDKEKKKKEEKSKDKKEEEKKEVVVIDPSGNTYYNWLFCITLPVMYNWTMVIARACFDELQSDYLEYWLILDYVSDIVYLIDMFVRTRTGYLEQGLLVKEELKLINKYKSNLQFKLDVLSLIPTDLLYFKLGWNYPEIRLNRLLRFSRMFEFFQRTETRTNYPNIFRISNLVMYIVIIIHWNACVFYSISKAIGFGNDTWVYPDINDPEFGRLARKYVYSLYWSTLTLTTIGETPPPVRDSEYVFVVVDFLIGVLIFATIVGNIGSMISNMNAARAEFQARIDAIKQYMHFRNVSKDMEKRVIKWFDYLWTNKKTVDEKEVLKYLPDKLRAEIAINVHLDTLKKVRIFADCEAGLLVELVLKLQPQVYSPGDYICKKGDIGREMYIIKEGKLAVVADDGVTQFVVLSDGSYFGEISILNIKGSKAGNRRTANIKSIGYSDLFCLSKDDLMEALTEYPDAKTMLEEKGKQILMKDGLLDLNIANAGSDPKDLEEKVTRMEGSVDLLQTRFARILAEYESMQQKLKQRLTKVEKFLKPLIDTEFSSIEGPGAESGPIDST

SEQ ID NO: 1038 - protein, 223 aa, Homo sapiens
  misc_feature (0)...(0): Polypeptide Accession Number P30041
PGGLLLGDVAPNFEANTTVGRIRFHDFLGDSWGILFSHPRDFTPVCTTELGRAAKLAPEFAKRNVKLIALSIDSVEDHLAWSKDINAYNCEEPTEKLPFPIIDDRNRELAILLGMLDPAEKDEKGMPVTARVVFVFGPDKKLKLSILYPATTGRNFDEILRVVISLQLTAEKRVATPVDWKDGDSVMVLPTIPEEEAKKLFPKGVFTKELPSGKKYLRYTPQP

SEQ ID NO: 1039 - protein, 256 aa, Homo sapiens
  misc_feature (0)...(0): Polypeptide Accession Number P30048
MAAAVGRLLRASVARHVSAIPWGISATAALRPAACGRTSLTNLLCSGSSQAKLFSTSSSCHAPAVTQHAPYFKGTAVVNGEFKDLSLDDFKGKYLVLFFYPLDFTFVCPTEIVAFSDKANEFHDVNCEVVAVSVDSHFSHLAWINTPRKNGGLGHMNIALLSDLTKQISRDYGVLLEGSGLALRGLFIIDPNGVIKHLSVNDLPVGRSVEETLRLVKAFQYVETHGEVCPANWTPDSPTIKPSPAASKEYFQKVNQ

SEQ ID NO: 1040 - protein, 588 aa, Homo sapiens
  misc_feature (0)...(0): Polypeptide Accession Number P30153
AAADGDDSLYPIAVLIDELRNEDVQLRLNSIKKLSTIALALGVERTRSELLPFLTDTIYDEDEVLLALAEQLGTFTTLVGGPEYVHCLLPPLESLATVEETVVRDKAVESLRAISHEHSPSDLEAHFVPLVKRLAGGDWFTSRTSACGLFSVCYPRVSSAVKAELRQYFRNLCSDDTPMVRRAAASKLGEFAKVLELDNVKSEIIPMFSNLASDEQDSVRLLAVEACVNIAQLLPQEDLEALVMPTLRQAAEDKSWAVRYMVADKFTELQKAVGPEITKTDLVPAFQNLMKDCEAEVRAAASHKVKEFCENLSADCRENVIMSQILPCIKELVSDANQHVKSALASVIMGLSPILGKDNTIEHLLPLFLAQLKDECPEVRLNIISNLDCVNEVIGIRQLSQSLLPAIVELAEDAKWRVRLAIIEYMPLLAGQLGVEFFDEKLNSLCMAWLVDHVYAIREAATSNLKKLVEKFGKEWAHATIIPKVLAMSGDPNYLHRMTTLFCINVLSEVCGQDITTKHMLPTVLRMAGDPVANVRFNVAKSLQKIGPILDNSTLQSEVKPILEKLTQDQDVDVKYFAQEALTVLSLA

SEQ ID NO: 1041 - protein, 824 aa, Homo sapiens
  misc_feature (0)...(0): Polypeptide Accession Number P30260
MTVLQEPVQAAIWQALNHYAYRDAVFLAERLYAEVHSEEALFLLATCYYRSGKAYKAYRLLKGHSCTTPQCKYLLAKCCVDLSKLAEGEQILSGGVFNKQKSHDDIVTEFGDSACFTLSLLGHVYCKTDRLAKGSECYQKSLSLNPFLWSPFESLCEIGEKPDPDQTFKFTSLQNFSNCLPNSCTTQVPNHSLSHRQPETVLTETPQDTIELNRLNLESSNSKYSLNTDSSVSYIDSAVISPDTVPLGTGTSILSKQVQNKPKTGRSLLGGPAALSPLTPSFGILPLETPSPGDGSYLQNYTNTPPVIDVPSTGAPSKKSVARIGQTGTKSVFSQSGNSREVTPILAQTQSSGPQTSTTPQVLSPTITSPPNALPRRSSRLFTSDSSTTKENSKKLKMKFPPKIPNRKTKSKTNKGGITQPNINDSLEITKLDSSIISEGKISTITPQIQAFNLQKAAAEGLMSLLREMGKGYLALCSYNCKEAINILSHLPSHHYNTGWVLCQIGRAYFELSEYMQAERIFSEVRRIENYRVEGMEIYSTTLWHLQKDVALSVLSKDLTDMDKNSPEAWCAAGNCFSLQREHDIAIKFFQRAIQVDPNYAYAYTLLGHEFVLTEELDKALACFRNAIRVNPRHYNAWYGLGMIYYKQEKFSLAEMHFQKALDINPQSSVLLCHIGVVQHALKKSEKALDTLNKAIVIDPKNPLCKFHRASVLFANEKYKSALQELEELKQIVPKESLVYFLIGKVYKKLGQTHLALMNFSWAMDLDPKGANNQIKEAIDKRYLPDDEEPITQEEQIMGTDESQESSMTDADDTQLHAAESDEF

SEQ ID NO: 1042 - protein, 207 aa, Homo sapiens
  misc_feature (0)...(0): Polypeptide Accession Number P30405
MLALRCGSRWLGLLSVPRSVPLRLPAARACSKGSGDPSSSSSSGNPLVYLDVDANGKPLGRVVLELKADVVPKTAENFRALCTGEKGFGYKGSTFHRVIPSFMCQAGDFTNHNGTGGKSIYGSRFPDENFTLKHVGPGVLSMANAGPNTNGSQFFICTIKTDWLDGKHVVFGHVKEGMDVVKKIESFGSKSGRTSKKIVITDCGQLS

SEQ ID NO: 1043 - protein, 1462 aa, Homo sapiens
  misc_feature (0)...(0): Polypeptide Accession Number P30414
MGAQDRPQCHFDIEINREPVGRIMFQLFSDICPKTCKNFLCLCSGEKGLGKTTGKKLCYKGSTFHRVVKNFMIQGGDFSEGNGKGGESIYGGYFKDENFILKHDRAFLLSMANRGKHTNGSQFFITTKPAPHLDGVHVVFGLVISGFEVIEQIENLKTDAASRPYADVRVIDCGVLATKSIKDVFEKKRKKPTHSEGSDSSSNSSSSSESSSESELEHERSRRRKHKRRPKVKRSKKRRKEASSSEEPRNKHAMNPKGHSERSDTNEKRSVDSSAKREKPVVRPEEIPPVPENRFLLRRDMPVVTAEPEPKIPDVAPIVSDQKPSVSKSGRKIKGRGTIRYHTPPRSRSCSESDDDDSSETPPHWKEEMQRLRAYRPPSGEKWSKGDKLSDPCSSRWDERSLSQRSRSWSYNGYYSDLSTARHSGHHKKRRKEKKVKHKKKGKKQKHCRRHKQTKKRRILIPSDIESSKSSTRRMKSSCDRERSSRSSSLSSHHSSKRDWSKSDKDVQSSLTHSSRDSYRSKSHSQSYSRGSSRSRTASKSSSHSRSRSKSRSSSKSGHRKRASKSPRKTASQLSENKPVKTEPLRATMAQNENVVVQPVVAENIPVIPLSDSPPPSRWKPGQKPWKPSYERIQEMKAKTTHLLPIQSTYSLANIKETGSSSSYHKREKNSESDQSTYSKYSDRSSESSPRSRSRSSRSRSYSRSYTRSRSLASSHSRSRSPSSRSHSRNKYSDHSQCSRSSSYTSISSDDGRRAKRRLRSSGKKNSVSHKKHSSSSEKTLHSKYVKGRDRSSCVRKYSESRSSLDYSSDSEQSSVQATQSAQEKEKQGQMERTHNKQEKNRGEEKSKSERECPHSKKRTLKENLSDHLRNGSKPKRKNYAGSKWDSESNSERDVTKNSKNDSHPSSDKEEGEATSDSESEVSEIHIKVKPTTKSSTNTSLPDDNGAWKSSKQRTSTSDSEGSCSNSENNRGKPQKHKHGSKENLKREHTKKVKEKLKGKKDKKHKAPKRKQAFHWQPPLEFGEEEEEEIDDKQVTQESKEKKVSENNETIKDNILKTEKSSEEDLSGKHDTVTVSSDLDQFTKDDSKLSISPTALNTEENVACLQNIQHVEESVPNGVEDVLQTDDNMEICTPDRSSPAKVEETSPLGNARLDTPDINIVLKQDMATEHPQAEVVKQESSMSESKVLGEVGKQDSSSASLASAGESTGKKEVAEKSQINLIDKKWKPLQGVGNLAAPNAATSSAVEVKVLTTVPEMKPQGLRIEIKSKNKVRPGSLFDEVRKTARLNRRPRNQESSSDEQTPSRDDDSQSRSPSRSRSKSETKSRHRTRSVSYSHSRSRSRSSTSSYRSRSYSRSRSRGWYSRGRTRSRSSSYRSYKSHRTSSRSRSRSSSYDPHSRSRSYTYDSYYSRSRSRSRSQRSDSYHRGRSYNRRSRSCRSYGSDSESDRSYSHHRSPSESSRYS

SEQ ID NO: 1044 - protein, 1427 aa, Homo sapiens
  misc_feature (0)...(0): Polypeptide Accession Number P30622
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDGAVAGTRYFQCQPKYGLFAPVHKVTKIGFPSTTPAKAKANAVRRVMATTSASLKRSPSASSLSSMSSVASSVSSRPSRTGLLTETSSRYARKISGTTALQEALKEKQQHIEQLLAERDLERAEVAKATSHVGEIEQELALARDGHDQHVLELEAKMDQLRTMVEAADREKVELLNQLEEEKRKVEDLQFRVEEESITKGDLETQTKLEHARIKELEQSLLFEKTKADKLQRELEDTRVATVSEKSRIMELEKDLALRVQEVAELRRRLESNKPAGDVDMSLSLLQEISSLQEKLEVTRTDHQREITSLKEHFGAREETHQKEIKALYTATEKLSKENESLKSKLEHANKENSDVIALWKSKLETAIASHQQAMEELKVSFSKGLGTETAEFAELKTQIEKMRLDYQHEIENLQNQQDSERAAHAKEMEALRAKLMKVIKEKENSLEAIRSKLDKAEDQHLVEMEDTLNKLQEAEIKVKELEVLQAKCNEQTKVIDNFTSQLKATEEKLLDLDALRKASSEGKSEMKKLRQQLEAAEKQIKHLEIEKNAESSKASSITRELQGRELKLTNLQENLSEVSQVKETLEKELQILKEKFAEASEEAVSVQRSMQETVNKLHQKEEQFNMLSSDLEKLRENLADMEAKFREKDEREEQLIKAKEKLENDIAEIMKMSGDNSSQLTKMNDELRLKERDVEELQLKLTKANENASFLQKSIEDMTVKAEQSQQEAAKKHEEEKKELERKLSDLEKKMETSHNQCQELKARYERATSETKTKHEEILQNLQKTLLDTEDKLKGAREENSGLLQELEELRKQADKAKAAQTAEDAMQIMEQMTKEKTETLASLEDTKQTNAKLQNELDTLKENNLKNVEELNKSKELLTVENQKMEEFRKEIETLKQAAAQKSQQLSALQEENVKLAEELGRSRDEVTSHQKLEEERSVLNNQLLEMKKRESKFIKDADEEKASLQKSISITSALLTEKDAELEKLRNEVTVLRGENASAKSLHSVVQTLESDKVKLELKVKNLELQLKENKRQLSSSSGNTDTQADEDERAQESQIDFLNSVIVDLQRKNQDLKMKVEMMSEAALNGNGDDLNNYDSDDQEKQSKKKPRLFCDICDCFDLHDTEDCPTQAQMSEDPPHSTHHGSRGEERPYCEICEMFGHWATNCNDDETF

SEQ ID NO: 1045 - protein, 198 aa, Homo sapiens
  misc_feature (0)...(0): Polypeptide Accession Number P30626
MAYPGHPGAGGGYYPGGYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 1046 - protein, 250 aa, Homo sapiens
  misc_feature (0)...(0): Polypeptide Accession Number P30793
MEKGPVRAPAEKPRGARCSNGFPERDPPRPGPSRPAEKPPRPEAKSAQPADGWKGERPRSEEDNELNLPNLAAAYSSILSSLGENPQRQGLLKTPWRAASAMQFFTKGYQETISDVLNDAIFDEDHDEMVIVKDIDMFSMCEHHLVPFVGKVHIGYLPNKQVLGLSKLARIVEIYSRRLQVQERLTKQIAVAITEALRPAGVGVVVEATHMCMVMRGVQKMNSKTVTSTMLGVFREDPKTREEFLTLIRS

SEQ ID NO: 1047 - protein, 517 aa, Homo sapiens
  misc_feature (0)...(0): Polypeptide Accession Number P30837
MLRFLAPRLLSLQGRTALYSSAAALPSPILNPDIPYNQLFINNEWQDAVSKKTFPTVNPTTGEVIGHVAEGDRADVDRAVKAAREAFRLGSPWRRMDASERGRLLNLLADLVERDRVYLASLETLDNGKPFQESYALDLDEVIKVYRYFAGWADKWHGKTIPMHGQHFCFTRHEPVGVCGQIIPWNFPLVMQGWKLAPALATGNTVVMKVAEQTPLSALYLASLIKEAGFPPGVVNIITGYGPTAGAAIAQHMDVDKVAFTGSTEVGHLIQKAAGDSNLKRVTLELGGKSPSIVLADADMEHAVEQCHEALFFNMGQCCCAGSRTFVEESIYNEFLERTVEKAKQRKVGNPFELDTQQGPQVDKEQFERVLGYIQLGQKEGAKLLCGGERFGERGFFIKPTVFGGVQDDMRIAKEEIFGPVQPLFKFKKIEEVVERANNTRYGLAAAVFTRDLDKAMYFTQALQAGTVWVNTYNIVTCHTPFGGFKESGNGRELGEDGLKAYTEVKTVTIKVPQKNS

SEQ ID NO: 1048 - protein, 461 aa, Homo sapiens
  misc_feature (0)...(0): Polypeptide Accession Number P31146
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 1049 - protein, 380 aa, Homo sapiens
  misc_feature (0)...(0): Polypeptide Accession Number P31321
ASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLWGIDRDSYRRILMGSTLRKRKMYEEFLSKVSILESLEKWERLTVADRLEPVQFEDGEKIVVQGEPGDDFYIITEGTASVLQRRSPNEEYVEVGRLGPSDYFGEIALLLNRPRAATVVARGPLKCVKLDRPRFERVLGPCSEILKRNIQRYNSFISLTV

SEQ ID NO: 1050 - protein, 417 aa, Homo sapiens
  misc_feature (0)...(0): Polypeptide Accession Number P31323
SIEIPAGLTELLQGFTVEVLRHQPADLLEFALQHFTRLQQENERKGTARFGHEGRTWGDLGAAAGGGTPSKGVNFAEEPMQSDSEDGEEEEAAPADAGAFNAPVINRFTRRASVCAEAYNPDEEEDDAESRIIHPKTDDQRNRLQEACKDILLFKNLDPEQMSQVLDAMFEKLVKDGEHVIDQGDDGDNFYVIDRGTFDIYVKCDGVGRCVGNYDNRGSFGELALMYNTPRAATITATSPGALWGLDRVTFRRIIVKNNAKKRKMYESFIESLPFLKSLEFSERLKVVDVIGTKVYNDGEQIIAQGDSADSFFIVESGEVKITMKRKGKSEVEENGAVEMPRCSRGQYFGELALVTNKPRAASAHAIGTVKCLAMDVQAFERLLGPCMEIMKRNIATYEEQLVALFGTNMDIVEPTA

SEQ ID NO: 1051 - protein, 1500 aa, Homo sapiens
  misc_feature (0)...(0): Polypeptide Accession Number P31327
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 1052 - protein, 397 aa, Homo sapiens
  misc_feature (0)...(0): Polypeptide Accession Number P31689
MVKETTYYDVLGVKPNATQEELKKAYRKLALKYHPDKNPNEGEKFKQISQAYEVLSDAKKRELYDKGGEQAIKEGGAGGGFGSPMDIFDMFFGGGGRMQRERRGKNVVHQLSVTLEDLYNGATRKLALQKNVICDKCEGRGGKKGAVECCPNCRGTGMQIRIHQIGPGMVQQIQSVCMECQGHGERISPKDRCKSCNGRKIVREKKILEVHIDKGMKDGQKITFHGEGDQEPGLEPGDIIIVLDQKDHAVFTRRGEDLFMCMDIQLVEALCGFQKPISTLDNRTIVITSHPGQIVKHGDIKCVLNEGMPIYRRPYEKGRLIIEFKVNFPENGFLSPDKLSLLEKLLPERKEVEETDEMDQVELVDFDPNQERRRHYNGEAYEDDEHHPRGGVQCQTS

SEQ ID NO: 1053 - protein, 480 aa, Homo sapiens
  misc_feature (0)...(0): Polypeptide Accession Number P31749
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGAEIVSALDYLHSEKNVVYRDLKLENLMLDKDGHIKITDFGLCKEGIKDGATMKTFCGTPEYLAPEVLEDNDYGRAVDWWGLGVVMYEMMCGRLPFYNQDHEKLFELILMEEIRFPRTLGPEAKSLLSGLLKKDPKQRLGGGSEDAKEIMQHRFFAGIVWQHVYEKKLSPPFKPQVTSETDTRYFDEEFTAQMITITPPDQDDSMECVDSERRPHFPQFSYSASSTA

SEQ ID NO: 1054 - protein, 481 aa, Homo sapiens
  misc_feature (0)...(0): Polypeptide Accession Number P31751
MNEVSVIKEGWLHKRGEYIKTWRPRYFLLKSDGSFIGYKERPEAPDQTLPPLNNFSVAECQLMKTERPRPNTFVIRCLQWTTVIERTFHVDSPDEREEWMRAIQMVANSLKQRAPGEDPMDYKCGSPSDSSTTEEMEVAVSKARAKVTMNDFDYLKLLGKGTFGKVILVREKATGRYYAMKILRKEVIIAKDEVAHTVTESRVLQNTRHPFLTALKYAFQTHDRLCFVMEYANGGELFFHLSRERVFTEERARFYGAEIVSALEYLHSRDVVYRDIKLENLMLDKDGHIKITDFGLCKEGISDGATMKTFCGTPEYLAPEVLEDNDYGRAVDWWGLGVVMYEMMCGRLPFYNQDHERLFELILMEEIRFPRTLSPEAKSLLAGLLKKDPKQRLGGGPSDAKEVMEHRFFLSINWQDVVQKKLLPPFKPQVTSEVDTRYFDDEFTAQSITITPPDRYDSLGLLELDQRTHFPQFSYSASIRE

SEQ ID NO: 1055 - protein, 198 aa, Homo sapiens
  misc_feature (0)...(0): Polypeptide Accession Number P32119
MASGNARIGKPAPDFKATAVVDGAFKEVKLSDYKGKYVVLFFYPLDFTFVCPTEIIAFSNRAEDFRKLGCEVLGVSVDSQFTHLAWINTPRKEGGLGPLNIPLLADVTRRLSEDYGVLKTDEGIAYRGLFIIDGKGVLRQITVNDLPVGRSVDEALRLVQAFQYTDEHGEVCPAGWKPGSDTIKPNVDDSKEYFSKHN

SEQ ID NO: 1056 - protein, 146 aa, Homo sapiens [sequence omitted]

SEQ ID NO: 1057 - protein, 319 aa, Homo sapiens [sequence omitted]

SEQ ID NO: 1058 - protein, 548 aa, Homo sapiens
  misc_feature (0)...(0): Polypeptide Accession Number P32780
MATSSEEVLLIVKKVRQKKQDGALYLMAERIAWAPEGKDRFTISHMYADIKCQKISPEGKAKIQLQLVLHAGDTTNFHFSNESTAVKERDAVKDLLQQLLPKFKRKANKELEEKNRMLQEDPVLFQLYKDLVVSQVISAEEFWANRLNVNATDSSSTSNHKQDVGISAAFLADVRPQTDGCNGLRYNLTSDIIESIFRTYPAVKMKYAENVPHNMTEKEFWTRFFQSHYFHRDRLNTGSKDLFAECAKIDEKGLKTMVSLGVKNPLLDLTALEDKPLDEGYGISSVPSASNSKSIKENSNAAIIKRFNHHSAMVLAAGLRKQEAQNEQTSEPSNMDGNSGDADCFQPAVKRAKLQESIEYEDLGKNNSVKTIALNLKKSDRYYHGPTPIQSLQYATSQDIINSFQSIRQEMEAYTPKLTQVLSSSAASSTITALSPGGALMQGGTQQAINQMVPNDIQSELKHLYVAVGELLRHFWSCFPVNTPFLEEKVVKMKSNLERFQVTKLCPFQEKIRRQYLSTNLVSHIEEMLQTAYNKLHTWQSRRLMKKT

SEQ ID NO: 1059 - protein, 405 aa, Homo sapiens
  misc_feature (0)...(0): Polypeptide Accession Number P32929
MQEKDASSQGFLPHFQHFATQAIHVGQDPEQWTSRAVVPPISLSTTFKQGAPGQHSGFEYSRSGNPTRNCLEKAVAALDGAKYCLAFASGLAATVTITHLLKAGDQIICMDDVYGGTNRYFRQVASEFGLKISFVDCSKIKLLEAAITPETKLVWIETPTNPTQKVIDIEGCAHIVHKHGDIILVVDNTFMSPYFQRPLALGADISMYSATKYMNGHSDVVMGLVSVNCESLHNRLRFLQNSLGAVPSPIDCYLCNRGLKTLHVRMEKHFKNGMAVAQFLESNPWVEKVIYPGLPSHPQHELVKRQCTGCTGMVTFYIKGTLQHAEIFLKNLKLFTLAESLGGFESLAELPAIMTHASVLKNDRDVLGISDTLIRLSVGLEDEEDLLEDLDQALKAAHPPSGIHS

SEQ ID NO: 1060 - protein, 963 aa, Homo sapiens
  misc_feature (0)...(0): Polypeptide Accession Number P33176
MADLAECNIKVMCRFRPLNESEVNRGDKYIAKFQGEDTVVIASKPYAFDRVFQSSTSQEQVYNDCAKKIVKDVLEGYNGTIFAYGQTSSGKTHTMEGKLHDPEGMGIIPRIVQDIFNYIYSMDENLEFHIKVSYFEIYLDKIRDLLDVSKTNLSVHEDKNRVPYVKGCTERFVCSPDEVMDTIDEGKSNRHVAVTNMNEHSSRSHSIFLINVKQENTQTEQKLSGKLYLVDLAGSEKVSKTGAEGAVLDEAKNINKSLSALGNVISALAEGSTYVPYRDSKMTRILQDSLGGNCRTTIVICCSPSSYNESETKSTLLFGQRAKTIKNTVCVNVELTAEQWKKKYEKEKEKNKILRNTIQWLENELNRWRNGETVPIDEQFDKEKANLEAFTVDKDITLTNDKPATAIGVIGNFTDAERRKCEEEIAKLYKQLDDKDEEINQQSQLVEKLKTQMLDQEELLASTRRDQDNMQAELNRLQAENDASKEEVKEVLQALEELAVNYDQKSQEVEDKTKEYELLSDELNQKSATLASIDAELQKLKEMTNHQKKRAAEMMASLLKDLAEIGIAVGNNDVKQPEGTGMIDEEFTVARLYISKMKSEVKTMVKRCKQLESTQTESNKKMEENEKELAACQLRISQHEAKIKSLTEYLQNVEQKKRQLEESVDALSEELVQLRAQEKVHEMEKEHLNKVQTANEVKQAVEQQIQSHRETHQKQISSLRDEVEAKAKLITDLQDQNQKMMLEQERLRVEHEKLKATDQEKSRKLHELTVMQDRREQARQDLKGLEETVAKELQTLHNLRKLFVQDLATRVKKSAEIDSDDTGGSAAQKQKISFLENNLEQLTKVHKQLVRDNADLRCELPKLEKRLRATAERVKALESALKEAKENASRDRKRYQQEVDRIKEAVRSKNMARRGHSAQIAKPIRPGQHPAASPTHPSAIRGGGAFVQNSQPVAVRGGGGKQV

SEQ ID NO: 1061 - protein, 577 aa, Homo sapiens
  misc_feature (0)...(0): Polypeptide Accession Number P33240
MAGLTVRDPAVDRSLRSVFVGNIPYEATEEQLKDIFSEVGPVVSFRLVYDRETGKPKGYGFCEYQDQETALSAMRNLNGREFSGRALRVDNAASEKNKEELKSLGTGAPVIESPYGETISPEDAPESISKAVASLPPEQMFELMKQMKLCVQNSPQEARNMLLQNPQLAYALLQAQVVMRIVDPEIALKILHRQTNIPTLIAGNPQPVHGAGPGSGSNVSMNQQNPQAPQAQSLGGMHVNGAPPLMQASMQGGVPAPGQMPAAVTGPGPGSLAPGGGMQAQVGMPGSGPVSMERGQVPMQDPRAAMQRGSLPANVPTPRGLLGDAPNDPRGGTLLSVTGEVEPRGYLGPPHQGPPMHHVPGHESRGPPPHELRGGPLPEPRPLMAEPRGPMLDQRGPPLDGRGGRDPRGIDARGMEARAMEARGLDARGLEARAMEARAMEARAMEARAMEARAMEVRGMEARGMDTRGPVPGPRGPIPSGMQGPSPINMGAVVPQGSRQVPVMQGTGMQGASIQGGSQPGGFSPGQNQVTPQDHEKAALIMQVLQLTADQIAMLPPEQRQSILILKEQIQKSTGAP

SEQ ID NO: 1062 - protein, 252 aa, Homo sapiens [sequence omitted]

SEQ ID NO: 1063 - protein, 79 aa, Homo sapiens [sequence omitted]

SEQ ID NO: 1064 - protein, 625 aa, Homo sapiens [sequence omitted]

SEQ ID NO: 1065 - protein, 246 aa, Homo sapiens
  misc_feature (0)...(0): Polypeptide Accession Number P34062
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKKVKKKFDWTFEQTVETAITCLSTVLSIDFKPSEIEVGVVTVENPKFRILTEAEIDAHLVALAERD

SEQ ID NO: 1066 - protein, 162 aa, Homo sapiens
  misc_feature (0)...(0): Polypeptide Accession Number P34991
PSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVRKENQWCEEK

SEQ ID NO: 1067 - protein, 781 aa, Homo sapiens
  misc_feature (0)...(0): Polypeptide Accession Number P35222
MATQADLMELDMAMEPDRKAAVSHWQQQSYLDSGIHSGATTTAPSLSGKGNPEEEDVDTSQVLYEWEQGFSQSFTQEQVADIDGQYAMTRAQRVRAAMFPETLDEGMQIPSTQFDAAHPTNVQRLAEPSQMLKHAVVNLINYQDDAELATRAIPELTKLLNDEDQVVVNKAAVMVHQLSKKEASRHAIMRSPQMVSAIVRTMQNTNDVETARCTAGTLHNLSHHREGLLAIFKSGGIPALVKMLGSPVDSVLFYAITTLHNLLLHQEGAKMAVRLAGGLQKMVALLNKTNVKFLAITTDCLQILAYGNQESKLIILASGGPQALVNIMRTYTYEKLLWTTSRVLKVLSVCSSNKPAIVEAGGMQALGLHLTDPSQRLVQNCLWTLRNLSDAATKQEGMEGLLGTLVQLLGSDDINVVTCAAGILSNLTCNNYKNKMMVCQVGGIEALVRTVLRAGDREDITEPAICALRHLTSRHQEAEMAQNAVRLHYGLPVVVKLLHPPSHWPLIKATVGLIRNLALCPANHAPLREQGAIPRLVQLLVRAHQDTQRRTSMGGTQQQFVEGVRMEEIVEGCTGALHILARDVHNRIVIRGLNTIPLFVQLLYSPIENIQRVAAGVLCELAQDKEAAEAIEAEGATAPLTELLHSRNEGVATYAAAVLFRMSEDKPQDYKKRLSVELTSSLFRTEPMAWNETADLGLDIGAQGEPLGYRQDDPSYRSFHSGGYGQDALGMDPMMEHEMGGHHPGADYPVDGLPDLGHAQDLMDGLPPGDSNQLAWFDTDL

SEQ ID NO: 1068 - protein, 326 aa, Homo sapiens [sequence omitted]

SEQ ID NO: 1069 - protein, 344 aa, Homo sapiens
  misc_feature (0)...(0): Polypeptide Accession Number P35227
MHRTTRIKITELNPHLMCALCGGYFIDATTIVECLHSFCKTCIVRYLETNKYCPMCDVQVHKTRPLLSIRSDKTLQDIVYKLVPGLFKDEMKRRRDFYAAYPLTEVPNGSNEDRGEVLEQEKGALSDDEIVSLSIEFYEGARDRDEKKGPLENGDGDKEKTGVRFLRCPAAMTVMHLAKFLRNKMDVPSKYKVEVLYEDEPLKEYYTLMDIAYIYPWRRNGPLPLKYRVQPACKRLTLATVPTPSEGTNTSGASECESVSDKAPSPATLPATSSSLPSPATPSHGSPSSHGPPATHPTSPTPPSTASGATTAANGGSLNCLQTPSSTSRGRKMTVNGAPVPPLT

SEQ ID NO: 1070 - protein, 1153 aa, Homo sapiens
  misc_feature (0)...(0): Polypeptide Accession Number P35228
MACPWKFLFKTKFHQYAMNGEKDINNNVEKAPCATSSPVTQDDLQYHNLSKQQNESPQPLVETGKKSPESLVKLDATPLSSPRHVRIKNWGSGMTFQDTLHHKAKGILTCRSKSCLGSIMTPKSLTRGPRDKPTPPDELLPQAIEFVNQYYGSFKEAKIEEHLARVEAVTKEIETTGTYQLTGDELIFATKQAWRNAPRCIGRIQWSNLQVFDARSCSTAREMFEHICRHVRYSTNNGNIRSAITVFPQRSDGKHDFRVWNAQLIRYAGYQMPDGSIRGDPANVEFTQLCIDLGWKPKYGRFDVVPLVLQANGRDPELFEIPPDLVLEVAMEHPKYEWFRELELKWYALPAVANMLLEVGGLEFPGCPFNGWYMGTEIGVRDFCDVQRYNILEEVGRRMGLETHKLASLWKDQAVVEINIAVLHSFQKQNVTIMDHHSAAESFMKYMQNEYRSRGGCPADWIWLVPPMSGSITPVFHQEMLNYVLSPFYYYQVEAWKTHVWQDEKRRPKRREIPLKVLVKAVLFACMLMRKTMASRVRVTILFATETGKSEALAWDLGALFSCAFNPKVVCMDKYRLSCLEEERLLLVVTSTFGNGDCPGNGEKLKKSLFMLKELNNKFRYAVFGLGSSMYPRFCAFAHDIDQKLSHLGASQLTPMGEGDELSGQEDAFRSWAVQTFKAACETFDVRGKQHIQIPKLYTSNVTWDPHHYRLVQDSQPLDLSKALSSMHAKNVFTMRLKSRQNLQSPTSSRATILVELSCEDGQGLNYLPGEHLGVCPGNQPALVQGILERVVDGPTPHQTVRLEALDESGSYWVSDKRLPPCSLSQALTYFLDITTPPTQLLLQKLAQVATEEPERQRLEALCQPSEYSKWKFTNSPTFLEVLEEFPSLRVSAGFLLSQLPILKPRFYSISSSRDHTPTEIHLTVAVVTYHTRDGQGPLHHGVCSTWLNSLKPQDPVPCFVRNASGFHLPEDPSHPCILIGPGTGIAPFRSFWQQRLHDSQHKGVRGGRMTLVFGCRRPDEDHIYQEEMLEMAQKGVLHAVHTAYSRLPGKPKVYVQDILRQQLASEVLRVLHKEPGHLYVCGDVRMARDVAHTLKQLVAAKLKLNEEQVEDYFFQLKSQKRYHEDIFGAVFPYEAKKDRVAVQPSSLEMSAL

SEQ ID NO: 1071 - protein, 583 aa, Homo sapiens
  misc_feature (0)...(0): Polypeptide Accession Number P35241
MPKPINVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAM

SEQ ID NO: 1072 - protein, 363 aa, Homo sapiens
  misc_feature (0)...(0): Polypeptide Accession Number P35249
MQAFLKGTSISTKPPLTKDRGVAASAGSSGENKKAKPVPWVEKYRPKCVDEVAFQEEVVAVLKKSLEGADLPNLLFYGPPGTGKTSTILAAARELFGPELFRLRVLELNASDERGIQVVREKVKNFAQLTVSGSRSDGKPCPPFKIVILDEADSMTSAAQAALRRTMEKESKTTRFCLICNYVSRIIEPLTSRCSKFRFKPLSDKIQQQRLLDIAKKENVKISDEGIAYLVKVSEGDLRKAITFLQSATRLTGGKEITEKVITDIAGVIPAEKIDGVFAACQSGSFDKLEAVVKDLIDEGHAATQLVNQLHDVVVENNLSDKQKSIITEKLAEVDKCLADGADEHLQLISLCATVMQQLSQNC

SEQ ID NO: 1073 - protein, 354 aa, Homo sapiens
  misc_feature (0)...(0): Polypeptide Accession Number P35250
MEVEAVCGGAGEVEAQDSDPAPAFSKAPGSAGHYELPWVEKYRPVKLNEIVGNEDTVSRLEVFAREGNVPNIIIAGPPGTGKTTSILCLARALLGPALKDAMLELNASNDRGIDVVRNKIKMFAQQKVTLPKGRHKIIILDEADSMTDGAQQALRRTMEIYSKTTRFALACNASDKIIEPIQSRCAVLRYTKLTDAQILTRLMNVIEKERVPYTDDGLEAIIFTAQGDMRQALNNLQSTFSGFGFINSENVFKVCDEPHPLLVKEMIQHCVNANIDEAYKILAHLWHLGYSPEDIIGNIFRVCKTFQMAEYLKLEFIKEIGYTHMKIAEGVNSLLQMAGLLARLCQKTMAPVAS

SEQ ID NO: 1074 - protein, 1147 aa, Homo sapiens [sequence omitted]

SEQ ID NO: 1075 - protein, 550 aa, Homo sapiens
  misc_feature (0)...(0): Polypeptide Accession Number P35520
PSETPQAEVGPTGCPHRSGPHSAKGSLEKGSPEDKEAKEPLWIRPDAPSRCTWQLGRPASESPHHHTAPAKSPKILPDILKKIGDTPMVRINKIGKKFGLKCELLAKCEFFNAGGSVKDRISLRMIEDAERDGTLKPGDTIIEPTSGNTGIGLALAAAVRGYRCIIVMPEKMSSEKVDVLRALGAEIVRTPTNARFDSPESHVGVAWRLKNEIPNSHILDQYRNASNPLAHYDTTADEILQQCDGKLDMLVASVGTGGTITGIARKLKEKCPGCRIIGVDPEGSILAEPEELNQTEQTTYEVEGIGYDFIPTVLDRTVVDKWFKSNDEEAFTFARMLIAQEGLLCGGSAGSTVAVAVKAAQELQEGQRCVVILPDSVRNYMTKFLSDRWMLQKGFLKEEDLTEKKPWWWHLRVQELGLSAPLTVLPTITCGHTIEILREKGFDQAPVVDEAGVILGMVTLGNMLSSLLAGKVQPSDQVGKVIYKQFKQIRLTDTLGRLSHILEMDHFALVVHEQIQYHSTGKSSQRQMVFGVVTAIDLLNFVAAQERDQK

SEQ ID NO: 1076 - protein, 2871 aa, Homo sapiens [sequence omitted]

SEQ ID NO: 1077 - protein, 1960 aa, Homo sapiens
  misc_feature (0)...(0): Polypeptide Accession Number P35579
MAQQAADKYLYVDKNFINNPLAQADWAAKKLVWVPSDKSGFEPASLKEEVGEEAIVELVENGKKVKVNKDDIQKMNPPKFSKVEDMAELTCLNEASVLHNLKERYYSGLIYTYSGLFCVVINPYKNLPIYSEEIVEMYKGKKRHEMPPHIYAITDTAYRSMMQDREDQSILCTGESGAGKTENTKKVIQYLAYVASSHKSKKDQGELERQLLQANPILEAFGNAKTVKNDNSSRFGKFIRINFDVNGYIVGANIETYLLEKSRAIRQAKEERTFHIFYYLLSGAGEHLKTDLLLEPYNKYRFLSNGHVTIPGQQDKDMFQETMEAMRIMGIPEEEQMGLLRVISGVLQLGNIVFKKERNTDQASMPDNTAAQKVSHLLGINVTDFTRGILTPRIKVGRDYVQKAQTKEQADFAIEALAKATYERMFRWLVLRINKALDKTKRQGASFIGILDIAGFEIFDLNSFEQLCINYTNEKLQQLFNHTMFILEQEEYQREGIEWNFIDFGLDLQPCIDLIEKPAGPPGILALLDEECWFPKATDKSFVEKVMQEQGTHPKFQKPKQLKDKADFCIIHYAGKVDYKADEWLMKNMDPLNDNIATLLHQSSDKFVSELWKDVDRIIGLDQVAGMSETALPGAFKTRKGMFRTVGQLYKEQLAKLMATLRNTNPNFVRCIIPNHEKKAGKLDPHLVLDQLRCNGVLEGIRICRQGFPNRVVFQEFRQRYEILTPNSIPKGFMDGKQACVLMIKALELDSNLYRIGQSKVFFRAGVLAHLEEERDLKITDVIIGFQACCRGYLARKAFAKRQQQLTAMKVLQRNCAAYLKLRNWQWWRLFTKVKPLLQVSRQEEEMMAKEEELVKVREKQLAAENRLTEMETLQSQLMAEKLQLQEQLQAETELCAEAEELRARLTAKKQELEEICHDLEARVEEEEERCQHLQAEKKKMQQNIQELEEQLEEEESARQKLQLEKVTTEAKLKKLEEEQIILEDQNCKLAKEKKLLEDRIAEFTTNLTEEEEKSKSLAKLKNKHEAMITDLEERLRREEKQRQELEKTRRKLEGDSTDLSDQIAELQAQIAELKMQLAKKEEELQAALARVEEEAAQKNMALKKIRELESQISELQEDLESERASRNKAEKQKRDLGEELEALKTELEDTLDSTAAQQELRSKREQEVNILKKTLEEEAKTHEAQIQEMRQKHSQAVEELAEQLEQTKRVKANLEKAKQTLENERGELANEVKVLLQGKGDSEHKRKKVEAQLQELQVKFNEGERVRTELADKVTKLQVELDNVTGLLSQSDSKSSKLTKDFSALESQLQDTQELLQEENRQKLSLSTKLKQVEDEKNSFREQLEEEEEAKHNLEKQIATLHAQVADMKKKMEDSVGCLETAEEVKRKLQKDLEGLSQRHEEKVAAYDKLEKTKTRLQQELDDLLVDLDHQRQSACNLEKKQKKFDQLLAEEKTISAKYAEERDRAEAEAREKETKALSLARALEEAMEQKAELERLNKQFRTEMEDLMSSKDDVGKSVHELEKSKRALEQQVEEMKTQLEELEDELQATEDAKLRLEVNLQAMKAQFERDLQGRDEQSEEKKKQLVRQVREMEAELEDERKQRSMAVAARKKLEMDLKDLEAHIDSANKNRDEAIKQLRKLQAQMKDCMRELDDTRASREEILAQAKENEKKLKSMEAEMIQLQEELAAAERAKRQAQQERDELADEIANSSGKGALALEEKRRLEARIAQLEEELEEEQGNTELINDRLKKANLQIDQINTDLNLERSHAQKNENARQQLERQNKELKVKLQEMEGTVKSKYKASITALEAKIAQLEEQLDNETKERQAACKQVRRTEKKLKDVLLQVDDERRNAEQYKDQADKASTRLKQLKRQLEEAEEEAQRANASRRKLQRELEDATETADAMNREVSSLKNKLRRGDLPFVVPRRMARKGAGDGSDEEVDGKADGAEAKPAE

SEQ ID NO: 1078 - protein, 1976 aa, Homo sapiens
  misc_feature (0)...(0): Polypeptide Accession Number P35580
MAQRTGLEDPERYLFVDRAVIYNPATQADWTAKKLVWIPSERHGFEAASIKEERGDEVMVELAENGKKAMVNKDDIQKMNPPKFSKVEDMAELTCLNEASVLHNLKDRYYSGLIYTYSGLFCVVINPYKNLPIYSENIIEMYRGKKRHEMPPHIYAISESAYRCMLQDREDQSILCTGESGAGKTENTKKVIQYLAHVASSHKGRKDHNIPGELERQLLQANPILESFGNAKTVKNDNSSRFGKFIRINFDVTGYIVGANIETYLLEKSRAVRQAKDERTFHIFYQLLSGAGEHLKSDLLLEGFNNYRFLSNGYIPIPGQQDKDNFQETMEAMHIMGFSHEEILSMLKVVSSVLQFGNISFKKERNTDQASMPENTVAQKLCHLLGMNVMEFTRAILTPRIKVGRDYVQKAQTKEQADFAVEALAKATYERLFRWLVHRINKALDRTKRQGASFIGILDIAGFEIFELNSFEQLCINYTNEKLQQLFNHTMFILEQEEYQREGIEWNFIDFGLDLQPCIDLIERPANPPGVLALLDEECWFPKATDKTFVEKLVQEQGSHSKFQKPRQLKDKADFCIIHYAGKVDYKADEWLMKNMDPLNDNVATLLHQSSDRFVAELWKDVDRIVGLDQVTGMTETAFGSAYKTKKGMFRTVGQLYKESLTKLMATLRNTNPNFVRCIIPNHEKRAGKLDPHLVLDQLRCNGVLEGIRICRQGFPNRIVFQEFRQRYEILTPNAIPKGFMDGKQACERMIRALELDPNLYRIGQSKIFFRAGVLAHLEEERDLKITDIIIFFQAVCRGCLARKAFAKKQQQLSALKVLQRNCAAYLKLRHWQWWRVFTKVKPLLQVTRQEEELQAKDEELLKVKEKQTKVEGELEEMERKHQQLLEEKNILAEQLQAETELFAEAEEMRARLAAKKQELEEILHDLESRVEEEEERNQILQNEKKKMQAHIQDLEEQLDEEEGARQKLQLEKVTAEAKIKKMEEEILLLEDQNSKFIKEKKLMEDRIAECSSQLAEEEEKAKNLAKIRNKQEVMISDLEERLKKEEKTRQELEKAKRKLDGETTDLQDQIAELQAQIDELKLQLAKKEEELQGALARGDDETLHKNNALKVVRELQAQIAELQEDFESEKASRNKAEKQKRDLSEELEALKTELEDTLDTTAAQQELRTKREQEVAELKKALEEETKNHEAQIQDMRQRHATALEELSEQLEQAKRFKANLEKNKQGLETDNKELACEVKVLQQVKAESEHKRKKLDAQVQELHAKVSEGDRLRVELAEKASKLQNELDNVSTLLEEAEKKGIKFAKDAASLESQLQDTQELLQEETRQKLNLSSRIRQLEEEKNSLQEQQEEEEEARKNLEKQVLALQSQLADTKKKVDDDLGTIESLEEAKKKLLKDAEALSQRLEEKALAYDKLEKTKNRLQQELDDLTVDLDHQRQVASNLEKKQKKFDQLLAEEKSISARYAEERDRAEAEAREKETKALSLARALEEALEAKEEFERQNKQLRADMEDLMSSKDDVGKNVHELEKSKRALEQQVEEMRTQLEELEDELQATEDAKLRLEVNMQAMKAQFERDLQTRDEQNEEKKRLLIKQVRELEAELEDERKQRALAVASKKKMEIDLKDLEAQIEAANKARDEVIKQLRKLQAQMKDYQRELEEARASRDEIFAQSKESEKKLKSLEAEILQLQEELASSERARRHAEQERDELADEITNSASGKSALLDEKRRLEARIAQLEEELEEEQSNMELLNDRFRKTTLQVDTLNAELAAERSAAQKSDNARQQLERQNKELKAKLQELEGAVKSKFKATISALEAKIGQLEEQLEQEAKERAAANKLVRRTEKKLKEIFMQVEDERRHADQYKEQMEKANARMKQLKRQLEEAEEEATRANASRRKLQRELDDATEANEGLSREVSTLKNRLRRGGPISFSSSRSGRRQLHLEGASLELSDDDTESKTSDVNETQPPQSE

SEQ ID NO: 1079 - protein, 905 aa, Homo sapiens
  misc_feature (0)...(0): Polypeptide Accession Number P35606
PLRLDIKRKLTARSDRVKSVDLHPTEPWMLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 1080 - protein, 526 aa, Homo sapiens
  misc_feature (0)...(0): Polypeptide Accession Number P35637
MASNDYTQQATQSYGAYPTQPGQGYSQQSSQPYGQQSYSGYSQSTDTSGYGQSSYSSYGQSQNTGYGTQSTPQGYGSTGGYGSSQSSQSSYGQQSSYPGYGQQPAPSSTSGSYGSSSQSSSYGQPQSGSYSQQPSYGGQQQSYGQQQSYNPPQGYGQQNQYNSSSGGGGGGGGGGNYGQDQSSMSSGGGSGGGYGNQDQSGGGGSGGYGQQDRGGRGRGGSGGGGGGGGGGYNRSSGGYEPRGRGGGRGGRGGMGGSDRGGFNKFGGPRDQGSRHDSEQDNSDNNTIFVQGLGENVTIESVADYFKQIGIIKTNKKTGQPMINLYTDRETGKLKGEATVSFDDPPSAKAAIDWFDGKEFSGNPIKVSFATRRADFNRGGGNGRGGRGRGGPMGRGGYGGGGSGGGGRGGFPSGGGGGGGQQRAGDWKCPNPTCENMNFSWRNECNQCKAPKPDGPGGGPGGSHMGGNYGDDRRGGRGGYDRGGYRGRGGDRGGFRGGRGGGDRGGFGPGKMDSRGEHRQDRRERPY

SEQ ID NO: 1081 - protein, 2090 aa, Homo sapiens [sequence omitted]

SEQ ID NO: 1082 - protein, 375 aa, Homo sapiens
  misc_feature (0)...(0): Polypeptide Accession Number P35659
MSASAPAAEGEGTPTQPASEKEPEMPGPREESEEEEDEDDEEEEEEEKEKSLIVEGKREKKKVERLTMQVSSLQREPFTIAQGKGQKLCEIERIHFFLSKKKTDELRNLHKLLYNRPGTVSSLKKNVGQFSGFPFEKGSVQYKKKEEMLKKFRNAMLKSICEVLDLERSGVNSELVKRILNFLMHPKPSGKPLPKSKKTCSKGSKKERNSSGMARKAKRTKCPEILSDESSSDEDEKKNKEESSDDEDKESEEEPPKKTAKREKPKQKATSKSKKSVKSANVKKADSSTTKKNQNSSKKESESEDSSDDEPLIKKLKKPPTDEELKETIKKLLASANLEEVTMKQICKKVYENYPTYDLTERKDFIKTTVKELIS

SEQ ID NO: 1083 - protein, 598 aa, Homo sapiens
  misc_feature (0)...(0): Polypeptide Accession Number P35663
GQITVTRHDKRKLEEGQKPAHKWIRHSFRKILQWPPIYTAAREQTPFRHLYTSKTHLKKAEYKKSKDEKGGTPLKKDSKKKGGSYATNPESKQIVEEKTKRQNEADKTPLKSSHENEQSKKSKSSSETNPESQNSKTVSKNCSQKDKKDSKNSKKTNTEFLHTKNNPKKDLKRSKTSNDPISEICSENSLNVDFLMLVGQSDDESINFDAWLRNYSQNNSKNYSLKYTKYTKKDTKKNAKKSSDAESEDSKDAKKDSKKVKKNVKKDDKKKDVKKDTESTDAESGDSKDERKDTKKDKKKLKKDDKKKDTKKYPESTDTESGDAKDARNDSRNLKKASKNDDKKKDAKKITFSTDSESELESKESQKDEKKDKKDSKTDNKKSVKNDEESTDADSEPKGDSKKGKKDEKKGKKDSKKDDKKKDAKKNAESTEMESDLELKKDKKHSKEKKGSKKDIKKDARKDTESTDAEFDESSKTGFKTSTKIKGSDTESEESLYKPGAKKKIDESDGTSANSKMEGLESKRGFRMSSKKTTFNEKGEKASTGRVPPSREKPPLPACEPSLPSPKVRRLCWCKMPPPPPKPRYAPLPEAPWIHKLL

SEQ ID NO: 1084 - protein, 1972 aa, Homo sapiens
  misc_feature (0)...(0): Polypeptide Accession Number P35749
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRRGNETSFVPSRRSGGRRVIENADGSEEETDTRDADFNGTKASE

SEQ ID NO: 1085 - protein, 105 aa, Homo sapiens
  misc_feature (0)...(0): Polypeptide Accession Number P35754
AQEFVNCKIQPGKVVVFIKPTCPYCRRAQEILSQLPIKQGLLEFVDITATNHTNEIQDYLQQLTGARTVPRVFIGKDCIGGCSDLVSLQQSGELLTRLKQIGALQ

SEQ ID NO: 1086 - protein, 382 aa, Homo sapiens
  misc_feature (0)...(0): Polypeptide Accession Number P35813
MGAFLDKPKMEKHNAQGQGNGLRYGLSSMQGWRVEMEDAHTAVIGLPSGLESWSFFAVYDGHAGSQVAKYCCEHLLDHITNNQDFKGSAGAPSVENVKNGIRTGFLEIDEHMRVMSEKKHGADRSGSTAVGVLISPQHTYFINCGDSRGLLCRNRKVHFFTQDHKPSNPLEKERIQNAGGSVMIQRVNGSLAVSRALGDFDYKCVHGKGPTEQLVSPEPEVHDIERSEEDDQFIILACDGIWDVMGNEELCDFVRSRLEVTDDLEKVCNEVVDTCLYKGSRDNMSVILICFPNAPKVSPEAVKKEAELDKYLECRVEEIIKKQGEGVPDLVHVMRTLASENIPSLPPGGELASKRNVIEAVYNRLNPYKNDDTDSTSTDDMW

SEQ ID NO: 1087 - protein, 605 aa, Homo sapiens
  misc_feature (0)...(0): Polypeptide Accession Number P35858
MALRKGGLALALLLLSWVALGPRSLEGADPGTPGEAEGPACPAACVCSYDDDADELSVFCSSRNLTRLPDGVPGGTQALWLDGNNLSSVPPAAFQNLSSLGFLNLQGGQLGSLEPQALLGLENLCHLHLERNQLRSLALGTFAHTPALASLGLSNNRLSRLEDGLFEGLGSLWDLNLGWNSLAVLPDAAFRGLGSLRELVLAGNRLAYLQPALFSGLAELRELDLSRNALRAIKANVFVQLPRLQKLYLDRNLIAAVAPGAFLGLKALRWLDLSHNRVAGLLEDTFPGLLGLRVLRLSHNAIASLRPRTFKDLHFLEELQLGHNRIRQLAERSFEGLGQLEVLTLDHNQLQEVKAGAFLGLTNVAVMNLSGNCLRNLPEQVFRGLGKLHSLHLEGSCLGRIRPHTFTGLSGLRRLFLKDNGLVGIEEQSLWGLAELLELDLTSNQLTHLPHRLFQGLGKLEYLLLSRNRLAELPADALGPLQRAFWLDVSHNRLEALPNSLLAPLGRLRYLSLRNNSLRTFTPQPPGLERLWLEGNPWDCGCPLKALRDFALQNPSAVPRFVQAICEGDDCQPPAYTYNNITCASPPEVVGLDLRDLSEAHFAPC

SEQ ID NO: 1088 - protein, 433 aa, Homo sapiens
  misc_feature (0)...(0): Polypeptide Accession Number P35998
MPDYLGADQRKTKEDEKDDKPIRALDEGDIALLKTYGQSTYSRQIKQVEDDIQQLLKKINELTGIKESDTGLAPPALWDLAADKQTLQSEQPLQVARCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 1089 - protein, 269 aa, Homo sapiens
  misc_feature (0)...(0): Polypeptide Accession Number P36402
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTETNWPRELKDGNGQESLSMSSSSSPA

SEQ ID NO: 1090 - protein, 354 aa, Homo sapiens
  misc_feature (0)...(0): Polypeptide Accession Number P36551
MLPKTSGTRATSLGRPEEEEDELAHRCSSFMAPPVTDLGELRRRPGDMKTKMELLILETQAQVCQALAQVDGGANFSVDRWERKEGGGGISCVLQDGCVFEKAGVSISVVHGNLSEEAAKQMRSRGKVLKTKDGKLPFCAMGVSSVTHPKNPHAPTIHFNYRYFEVEEADGHKQWWFGGGCDLTPTYLNQEDAVHFHRTLKEACDQHGPDLYPKFKKWCDDYFFIAHRGERRGIGGIFFDDLDSPSKEEVFRFVQSCARAVVPSYIPLVKKHCDDSFTPQEKLWQQLRRGRYVEFNLLYDRGTKFGLFTPGSRIESILMSLPLTARWEYMHSPSENSKEAEILEVLRHPRDWVR

SEQ ID NO: 1091 - protein, 959 aa, Homo sapiens
  misc_feature (0)...(0): Polypeptide Accession Number P36776
MAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIVLPAENKKDFYDLAAFITEGLEVHFVEHYREIFDIAFPDEQAEALAVER

SEQ ID NO: 1092 - protein, 937 aa, Homo sapiens
  misc_feature (0)...(0): Polypeptide Accession Number P36777
MLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIILPAENKKDFYDLAAFITEGLEVHFVEHYREIFDIAFPDEQAEALAVER

SEQ ID NO: 1093 - protein, 323 aa, Homo sapiens
  misc_feature (0)...(0): Polypeptide Accession Number P36873
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQILKPAEKKKPNATRPVTPPRGMITKQAKK

SEQ ID NO: 1094 - protein, 197 aa, Homo sapiens
  misc_feature (0)...(0): Polypeptide Accession Number P36969
MSLGRLCRLLKPALLCGALAAPGLAGTMCASRDDWRCARSMHEFSAKDIDGHMVNLDKYRGFVCIVTNVASQCGKTEVNYTQLVDLHARYAECGLRILAFPCNQFGKQEPGSNEEIKEFAAGYNVKFDMFSKICVNGDDAHPLWKWMKIQPKGKGILGNAIKWNFTKFLIDKNGCVVKRYGPMEEPLVIEKDLPHYF

SEQ ID NO: 1095 - protein, 327 aa, Homo sapiens
  misc_feature (0)...(0): Polypeptide Accession Number P37140
MADGELNVDSLITRLLEVRGCRPGKIVQMTEAEVRGLCIKSREIFLSQPILLELEAPLKICGDIHGQYTDLLRLFEYGGFPPEANYLFLGDYVDRGKQSLETICLLLAYKIKYPENFFLLRGNHECASINRIYGFYDECKRRFNIKLWKTFTDCFNCLPIAAIVDEKIFCCHGGLSPDLQSMEQIRRIMRPTDVPDTGLLCDLLWSDPDKDVQGWGENDRGVSFTFGADVVSKFLNRHDLDLICRAHQVVEDGYEFFAKRQLVTLFSAPNYCGEFDNAGGMMSVDETLMCSFQILKPSEKKAKYQYGGLNSGRPVTPPRTANPPKKR

SEQ ID NO: 1096 - protein, 522 aa, Homo sapiens [sequence omitted]

SEQ ID NO: 1097 - protein, 391 aa, Homo sapiens
  misc_feature (0)...(0): Polypeptide Accession Number P38159
MVEADRPGKLFIGGLNTETNEKALEAVFGKYGRIVEVLLMKDRETNKSRGFAFVTFESPADAKDAARDMNGKSLDGKAIKVEQATKPSFESGRRGPPPPPRSRGPPRGLRGGRGGSGGTRGPPSRGGHMDDGGYSMNFNMSSSRGPLPVKRGPPPRSGGPPPKRSAPSGPVRSSSGMGGRAPVSRGRDSYGGPPRREPLPSRRDVYLSPRDDGYSTKDSYSSRDYPSSRDTRDYAPPPRDYTYRDYGHSSSRDDYPSREYSDRDGYGRDRDYSDHPSGGSYRDSYESYGNSRSAPPTRGPPPSYGGSSRYDDYSSSRDGYGGSRDSYSSSRSDLYSSGRDRVGRQERGLPPSMERGYPPPRDSYSSSSRGAPRGGGRGGSRSDRGGGRSRY

SEQ ID NO: 1098 - protein, 1863 aa, Homo sapiens
  misc_feature (0)...(0): Polypeptide Accession Number P38398
MDLSALRVEEVQNVINAMQKILECPICLELIKEPVSTKCDHIFCKFCMLKLLNQKKGPSQCPLCKNDITKRSLQESTRFSQLVEELLKIICAFQLDTGLEYANSYNFAKKENNSPEHLKDEVSIIQSMGYRNRAKRLLQSEPENPSLQETSLSVQLSNLGTVRTLRTKQRIQPQKTSVYIELGSDSSEDTVNKATYCSVGDQELLQITPQGTRDEISLDSAKKAACEFSETDVTNTEHHQPSNNDLNTTEKRAAERHPEKYQGSSVSNLHVEPCGTNTHASSLQHENSSLLLTKDRMNVEKAEFCNKSKQPGLARSQHNRWAGSKETCNDRRTPSTEKKVDLNADPLCERKEWNKQKLPCSENPRDTEDVPWITLNSSIQKVNEWFSRSDELLGSDDSHDGESESNAKVADVLDVLNEVDEYSGSSEKIDLLASDPHEALICKSERVHSKSVESNIEDKIFGKTYRKKASLPNLSHVTENLIIGAFVTEPQIIQERPLTNKLKRKRRPTSGLHPEDFIKKADLAVQKTPEMINQGTNQTEQNGQVMNITNSGHENKTKGDSIQNEKNPNPIESLEKESAFKTKAEPISSSISNMELELNIHNSKAPKKNRLRRKSSTRHIHALELVVSRNLSPPNCTELQIDSCSSSEEIKKKKYNQMPVRHSRNLQLMEGKEPATGAKKSNKPNEQTSKRHDSDTFPELKLTNAPGSFTKCSNTSELKEFVNPSLPREEKEEKLETVKVSNNAEDPKDLMLSGERVLQTERSVESSSISLVPGTDYGTQESISLLEVSTLGKAKTEPNKCVSQCAAFENPKGLIHGCSKDNRNDTEGFKYPLGHEVNHSRETSIEMEESELDAQYLQNTFKVSKRQSFAPFSNPGNAEEECATFSAHSGSLKKQSPKVTFECEQKEENQGKNESNIKPVQTVNITAGFPVVGQKDKPVDNAKCSIKGGSRFCLSSQFRGNETGLITPNKHGLLQNPYRIPPLFPIKSFVKTKCKKNLLEENFEEHSMSPEREMGNENIPSTVSTISRNNIRENVFKEASSSNINEVGSSTNEVGSSINEIGSSDENIQAELGRNRGPKLNAMLRLGVLQPEVYKQSLPGSNCKHPEIKKQEYEEVVQTVNTDFSPYLISDNLEQPMGSSHASQVCSETPDDLLDDGEIKEDTSFAENDIKESSAVFSKSVQKGELSRSPSPFTHTHLAQGYRRGAKKLESSEENLSSEDEELPCFQHLLFGKVNNIPSQSTRHSTVATECLSKNTEENLLSLKNSLNDCSNQVILAKASQEHHLSEETKCSASLFSSQCSELEDLTANTNTQDPFLIGSSKQMRHQSESQGVGLSDKELVSDDEERGTGLEENNQEEQSMDSNLGEAASGCESETSVSEDCSGLSSQSDILTTQQRDTMQHNLIKLQQEMAELEAVLEQHGSQPSNSYPSIISDSSALEDLRNPEQSTSEKAVLTSQKSSEYPISQNPEGLSADKFEVSADSSTSKNKEPGVERSSPSKCPSLDDRWYMHSCSGSLQNRNYPSQEELIKVVDVEEQQLEESGPHDLTETSYLPRQDLEGTPYLESGISLFSDDPESDPSEDRAPESARVGNIPSSTSALKVPQLKVAESAQSPAAAHTTDTAGYNAMEESVSREKPELTASTERVNKRMSMVVSGLTPEEFMLVYKFARKHHITLTNLITEETTHVVMKTDAEFVCERTLKYFLGIAGGKWVVSYFWVTQSIKERKMLNEHDFEVRGDVVNGRNHQGPKRARESQDRKIFRGLEICCYGPFTNMPTDQLEWMVQLCGASVVKELSSFTLGTGVHPIVVVQPDAWTEDNGFHAIGQMCEAPVVTREWVLDSVALYQCQELDTYLIPQIPHSHY

SEQ ID NO: 1099 - protein, 411 aa, Homo sapiens [sequence omitted]

SEQ ID NO: 1100 - protein, 993 aa, Homo sapiens
  misc_feature (0)...(0): Polypeptide Accession Number P38935
MASAAVESFVTKQLDLLELERDAEVEERRSWQENISLKELQSRGVCLLKLQVSSQRTGLYGRLLVTFEPRRYGSAAALPSNSFTSGDIVGLYDAANEGSQLATGILTRVTQKSVTVAFDESHDFQLSLDRENSYRLLKLANDVTYRRLKKALIALKKYHSGPASSLIEVLFGRSAPSPASEIHPLTFFNTCLDTSQKEAVSFALSQKELAIIHGPPGTGKTTTVVEIILQAVKQGLKVLCCAPSNIAVDNLVERLALCKQRILRLGHPARLLESVQQHSLDAVLARSDSAQNVADIRKDIDQVFVKNKKTQDKREKSNFRNEIKLLRKELKEREEAAMLESLTSANVVLATNTGASADGPLKLLPESYFDVVVIDECAQALEASCWIPLLKARKCILAGDHKQLPPTTVSHKAALAGLSLSLMERLAEEYGARVVRTLTVQYRMHQAIMRWASDTMYLGQVTAHSSVARHLLRDLPGVAATEETGVPLLLVDTAGCGLFELEEEDEQSKGNPGEVRLVSLHIQALVDAGVPARDIAVVSPYNLQVDLLRQSLVHRHPELEIKSVDGFQGREKEAVILSFVRSNRKGEVGFLAEDRRINVAVTRARRHVAVICDSRTVNNHAFLKTLVEYFTQHGEVRTAFEYLDDIVPENYSHENSQGSSHAATKPQGPATSTRTGSQRQEGGQEAAAPARQGRKKPAGKSLASEAPSQPSLNGGSPEGVESQDGVDHFRAMIVEFMASKKMQLEFPPSLNSHDRLRVHQIAEEHGLRHDSSGEGKRRFITVSKRAPRPRAALGPPAGTGGPAPLQPVPPTPAQTEQPPREQRGPDQPDLRTLHLERLQRVRSAQGQPASKEQQASGQQKLPEKKKKKAKGHPATDLPTEEDFEALVSAAVKADNTCGFAKCTAGVTTLGQFCQLCSRRYCLSHHLPEIHGCGERARAHARQRISREGVLYAGSGTKNGSLDPAKRAQLQRRLDKKLSELSNQRTSRRKERGT

SEQ ID NO: 1101 - protein, 249 aa, Homo sapiens
  misc_feature (0)...(0): Polypeptide Accession Number P39687
MEMGRRIHLELRNRTPSDVKELVLDNSRSNEGKLEGLTDEFEELEFLSTINVGLTSIANLPKLNKLKKLELSDNRVSGGLEVLAEKCPNLTHLNLSGNKIKDLSTIEPLKKLENLKSLDLFNCEVTNLNDYRENVFKLLPQLTYLDGYDRDDKEAPDSDAEGYVEGLDDEEEDEDEEEYDEDAQVVEDEEDEDEEEEGEEEDVSGEEEEDEEGYNDGEVDDEEDEEELGEEERGQKRKREPEDEGEDDD

SEQ ID NO: 1102 - protein, 1505 aa, Homo sapiens [sequence omitted]

SEQ ID NO: 1103 - protein, 340 aa, Homo sapiens
  misc_feature (0)...(0): Polypeptide Accession Number P40937
METSALKQQEQPAATKIRNLPWVEKYRPQTLNDLISHQDILSTIQKFINEDRLPHLLLYGPPGTGKTSTILACAKQLYKDKEFGSMVLELNASDDRGIDIIRGPILSFASTRTIFKKGFKLVILDEADAMTQDAQNALRRVIEKFTENTRFCLICNYLSKIIPALQSRCTRFRFGPLTPELMVPRLEHVVEEEKVDISEDGMKALVTLSSGDMRRALNILQSTNMAFGKVTEETVYTCTGHPLKSDIANILDWMLNQDFTTAYRNITELKTLKGLALHDILTEIHLFVHRVDFPSSVRIHLLTKMADIEYRLSVGTNEKIQLSSLIAAFQVTRDLIVAEA

SEQ ID NO: 1104 - protein, 706 aa, Homo sapiens
  misc_feature (0)...(0): Polypeptide Accession Number P41182
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCHSNIYSPKETIPEEARSDMHYSVAEGLKPAAPSARNAPYFPCDKASKEEERPSSEDEIALHFEPPNAPLNRKGLVSPQSPQKSDCQPNSPTESCSSKNACILQASGSPPAKSPTDPKACNWKKYKFIVLNSLNQNAKPEGPEQAELGRLSPRAYTAPPACQPPMEPENLDLQSPTKLSASGEDSTIPQASRLNNIVNRSMTGSPRSSSESHSPLYMHPPKCTSCGSQSPQHAEMCLHTAGPTFPEEMGETQSEYSDSSCENGAFFCNECDCRFSEEASLKRHTLQTHSDKPYKCDRCQASFRYKGNLASHKTVHTGEKPYRCNICGAQFNRPANLKTHTRIHSGEKPYKCETCGARFVQVAHLRAHVLIHTGEKPYPCEICGTRFRHLQTLKSHLRIHTGEKPYHCEKCNLHFRHKSQLRLHLRQKHGAITNTKVQYRVSATDLPPELPKAC

SEQ ID NO: 1105 - protein, 144 aa, Homo sapiens
  misc_feature (0)...(0): Polypeptide Accession Number P41223
MPKVKRSRKAPQDGWELIEPTLDQLDQKMREAETEPHEGKRKVESLWPIFRIHHQKTRYIFDLFYKRKAYSRELLDICYKEGLADKNLLAKWKKQGIGNLCCLRCIQTRDTNFGTNCICRVPKSKLEVGRIIECTHCGCRGCSG

SEQ ID NO: 1106 - protein, 1011 aa, Homo sapiens
  misc_feature (0)...(0): Polypeptide Accession Number P41226
MDALDASKLLDEELYSRQLYVLGSPAMQRIQGARVLVSGLQGLGAEVAKNLVLMGVGSLTLHDPHPTCWSDLAAQFLLSEQDLERSRAEASQELLAQLNRAVQVVVHTGDITEDLLLDFQVVVLTAAKLEEQLKVGTLCHKHGVCFLAADTRGLVGQLFCDFGEDFTVQDPTEAEPLTAAIQHISQGSPGILTLRKGANTHYFRDGDLVTFSGIEGMVELNDCDPRSIHVREDGSLEIGDTTTFSRYLRGGAITEVKRPKTVRHKSLDTALLQPHVVAQSSQEVHHAHCLHQAFCALHKFQHLHGRPPQPWDPVDAETVVGLARDLEPLKRTEEEPLEEPLDEALVRTVALSSARCLEPMVACWVSSCPGSAEGNLQKFMPLDQWLYFDALDCLPEDGELLPSPEDCALRGSRYDGQIAVFGAGFQEKLRRQHYLLVGAGAIGCELLKVFALVGLGAGNSGGLTVVDMDHIERSNLSRQFLFRSQDVGRPKAEVAAAAARGLNPDLQVIPLTYPLDPTTEHIYGDNFFSRVDGVAAALDSFQARRYVAARCTHYLKPLLEAGTSGTWGSATVFMPHVTEAYRAPASAAASEDAPYPVCTVRYFPSTAEHTLQWARHEFEELFRLSAETINHHQQAHTSLADMDEPQTLTLLKPVLGVLRVRPQNWQDCVAWALGHWKLCFHYGIKQLLRHFPPNKVLEDGTPFWSGPKQCPQPLEFDTNQDTHLLYVLAAANLYAQMHGLPGSQDWTALRELLKLLPQPDPQQMAPIFASNLELASASAEFGPEQQKELNKALEVWSVGPPLKPLMFEKDDDSNFHVDFVVAAASLRCQNYGIPPVNRAQSKRIVGQIIPAIATTTAAVAGLLGLELYKVVSGPRPRSAFRHSYLHLAENYLIRYMPFAPAIQTFHHLKWTSWDRLKVPAGQPERTLESLLAHLQEQHGLRVRILLHGSALLYAAGWSPEKQAQHLPLRVTELVQQLTGQAPAPGQRVLVLELSCEGDDEDTAFPPLHYEL

SEQ ID NO: 1107 - protein, 450 aa, Homo sapiens
  misc_feature (0)...(0): Polypeptide Accession Number P41240
MSAIQAAWPSGTECIAKYNFHGTAEQDLPFCKGDVLTIVAVTKDPNWYKAKNKVGREGIIPANYVQKREGVKAGTKLSLMPWFHGKITREQAERLLYPPETGLFLVRESTNYPGDYTLCVSCDGKVEHYRIMYHASKLSIDEEVYFENLMQLVEHYTSDADGLCTRLIKPKVMEGTVAAQDEFYRSGWALNMKELKLLQTIGKGEFGDVMLGDYRGNKVAVKCIKNDATAQAFLAEASVMTQLRHSNLVQLLGVIVEEKGGLYIVTEYMAKGSLVDYLRSRGRSVLGGDCLLKFSLDVCEAMEYLEGNNFVHRDLAARNVLVSEDNVAKVSDFGLTKEASSTQDTGKLPVKWTAPEALREKKFSTKSDVWSFGILLWEIYSFGRVPYPRIPLKDVVPRVEKGYKMDAPDGCPPAVYEVMKNCWHLDAAMRPSFLQLREQLEHIKTHELHL

SEQ ID NO: 1108 - protein, 113 aa, Homo sapiens
  misc_feature (0)...(0): Polypeptide Accession Number P41567
MSAIQNLHSFDPFADASKGDDLLPAGTEDYIHIRIQQRNGRKTLTTVQGIADDYDKKKLVKAFKKKFACNGTVIEHPEYGEVIQLQGDQRKNICQFLVEIGLAKDDQLKVHGF

SEQ ID NO: 1109 - protein, 376 aa, Homo sapiens
  misc_feature (0)...(0): Polypeptide Accession Number P42024
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYLPDGSTIEIGPSRFRAPELLFRPDLIGEESEGIHEVLVFAIQKSDMDLRRTLFSNIVLSGGSTLFKGFGDRLLSEVKKLAPKDVKIRISAPQERLYSTWIGGSILASLDTFKKMWVSKKEYEEDGARSIHRKTF

SEQ ID NO: 1110 - protein, 376 aa, Homo sapiens
  misc_feature (0)...(0): Polypeptide Accession Number P42025
MESYDIIANQPVVIDNGSGVIKAGFAGDQIPKYCFPNYVGRPKHMRVMAGALEGDLFIGPKAEEHRGLLTIRYPMEHGVVRDWNDMERIWQYVYSKDQLQTFSEEHPVLLTEAPLNPSKNREKAAEVFFETFNVPALFISMQAVLSLYATGRTTGVVLDSGDGVTHAVPIYEGFAMPHSIMRVDIAGRDVSRYLRLLLRKEGVDFHTSAEFEVVRTIKERACYLSINPQKDEALETEKVQYTLPDGSTLDVGPARFRAPELLFQPDLVGDESEGLHEVVAFAIHKSDMDLRRTLFANIVLSGGSTLFKGFGDRLLSEVKKLAPKDIKIKISAPQERLYSTWIGGSILASLDTFKKMWVSKKEYEEDGSRAIHRKTF

SEQ ID NO: 1111 - protein, 1068 aa, Homo sapiens
  misc_feature (0)...(0): Polypeptide Accession Number P42336
MPPRPSSGELWGIHLMPPRILVECLLPNGMIVTLECLREATLVTIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPHVESSPELPKHIYNKLDRGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLKMMAKESLYSQLPMDCFTMPSYSRRISTATPYMNGETSTKSLWVINRALRIKILCATYVNLNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQERKDETQKVQMKFLVEQMRRPDFMDALQGLLSPLNPAHQLGNLRLKECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 1112 - protein, 2549 aa, Homo sapiens
  misc_feature (0)...(0): Polypeptide Accession Number P42345
MLGTGPAAATTAATTSSNVSVLQQFASGLKSRNEETRAKAAKELQHYVTMELREMSQEESTRFYDQLNHHIFELVSSSDANERKGGILAIASLIGVEGGNATRIGRFANYLRNLLPSNDPVVMEMASKAIGRLAMAGDTFTAEYVEFEVKRALEWLGADRNEGRRHAAVLVLRELAISVPTFFFQQVQPFFDNIFVAVWDPKQAIREGAVAALRACLILTTQREPKEMQKPQWYRHTFEEAEKGFDETLAKEKGMNRDDRIHGALLILNELVRISSMEGERLREEMEEITQQQLVHDKYCKDLMGFGTKPRHITPFTSFQAVQPQQSNALVGLLGYSSHQGLMGFGTSPSPAKSTLVESRCCRDLMEEKFDQVCQWVLKCRNSKNSLIQMTILNLLPRLAAFRPSAFTDTQYLQDTMNHVLSCVKKEKERTAAFQALGLLSVAVRSEFKVYLPRVLDIIRAALPPKDFAHKRQKAMQVDATVFTCISMLARAMGPGIQQDIKELLEPMLAVGLSPALTAVLYDLSRQIPQLKKDIQDGLLKMLSLVLMHKPLRHPGMPKGLAHQLASPGLTTLPEASDVGSITLALRTLGSFEFEGHSLTQFVRHCADHFLNSEHKEIRMEAARTCSRLLTPSIHLISGHAHVVSQTAVQVVADVLSKLLVVGITDPDPDIRYCVLASLDERFDAHLAQAENLQALFVALNDQVFEIRELAICTVGRLSSMNPAFVMPFLRKMLIQILTELEHSGIGRIKEQSARMLGHLVSNAPRLIRPYMEPILKALILKLKDPDPDPNPGVINNVLATIGELAQVSGLEMRKWVDELFIIIMDMLQDSSLLAKRQVALWTLGQLVASTGYVVEPYRKYPTLLEVLLNFLKTEQNQGTRREAIRVLGLLGALDPYKHKVNIGMIDQSRDASAVSLSESKSSQDSSDYSTSEMLVNMGNLPLDEFYPAVSMVALMRIFRDQSLSHHHTMVVQAITFIFKSLGLKCVQFLPQVMPTFLNVIRVCDGAIREFLFQQLGMLVSFVKSHIRPYMDEIVTLMREFWVMNTSIQSTIILLIEQIVVALGGEFKLYLPQLIPHMLRVFMHDNSPGRIVSIKLLAAIQLFGANLDDYLHLLLPPIVKLFDAPEAPLPSRKAALETVDRLTESLDFTDYASRIIHPIVRTLDQSPELRSTAMDTLSSLVFQLGKKYQIFIPMVNKVLVRHRINHQRYDVLICRIVKGYTLADEEEDPLIYQHRMLRSGQGDALASGPVETGPMKKLHVSTINLQKAWGAARRVSKDDWLEWLRRLSLELLKDSSSPSLRSCWALAQAYNPMARDLFNAAFVSCWSELNEDQQDELIRSIELALTSQDIAEVTQTLLNLAEFMEHSDKGPLPLRDDNGIVLLGERAAKCRAYAKALHYKELEFQKGPTPAILESLISINNKLQQPEAAAGVLEYAMKHFGELEIQATWYEKLHEWEDALVAYDKKMDTNKDDPELMLGRMRCLEALGEWGQLHQQCCEKWTLVNDETQAKMARMAAAAAWGLGQWDSMEEYTCMIPRDTHDGAFYRAVLALHQDLFSLAQQCIDKARDLLDAELTAMAGESYSRAYGAMVSCHMLSELEEVIQYKLVPERREIIRQIWWERLQGCQRIVEDWQKILMVRSLVVSPHEDMRTWLKYASLCGKSGRLALAHKTLVLLLGVDPSRQLDHPLPTVHPQVTYAYMKNMWKSARKIDAFQHMQHFVQTMQQQAQHAIATEDQQHKQELHKLMARCFLKLGEWQLNLQGINESTIPKVLQYYSAATEHDRSWYKAWHAWAVMNFEAVLHYKHQNQARDEKKKLRHASGANITNATTAATTAATATTTASTEGSNSESEAESTENSPTPSPLQKKVTEDLSKTLLMYTVPAVQGFFRSISLSRGNNLQDTLRVLTLWFDYGHWPDVNEALVEGVKAIQIDTWLQVIPQLIARIDTPRPLVGRLIHQLLTDIGRYHPQALIYPLTVASKSTTTARHNAANKILKNMCEHSNTLVQQAMMVSEELIRVAILWHEMWHEGLEEASRLYFGERNVKGMFEVLEPLHAMMERGPQTLKETSFNQAYGRDLMEAQEWCRKYMKSGNVKDLTQAWDLYYHVFRRISKQLPQLTSLELQYVSPKLLMCRDLELAVPGTYDPNQPIIRIQSIAPSLQVITSKQRPRKLTLMGSNGHEFVFLLKGHEDLRQDERVMQLFGLVNTLLANDPTSLRKNLSIQRYAVIPLSTNSGLIGWVPHCDTLHALIRDYREKKKILLNIEHRIMLRMAPDYDHLTLMQKVEVFEHAVNNTAGDDLAKLLWLKSPSSEVWFDRRTNYTRSLAVMSMVGYILGLGDRHPSNLMLDRLSGKILHIDFGDCFEVAMTREKFPEKIPFRLTRMLTNAMEVTGLDGNYRITCHTVMEVLREHKDSVMAVLEAFVYDPLLNWRLMDTNTKGNKRSRTRTDSYSAGQSVEILDGVELGEPAHKKTGTTVPESIHSFIGDGLVKPEALNKKAIQIINRVRDKLTGRDFSHDDTLDVPTQVELLIKQATSHENLCQCYIGWCPFW

SEQ ID NO: 1113 - protein, 896 aa, Homo sapiens [sequence omitted]

SEQ ID NO: 1114 - protein, 568 aa, Homo sapiens
  misc_feature (0)...(0): Polypeptide Accession Number P42568
MASSCSVQVKLELGHRAQVRKKPTVEGFTHDWMVFVRGPEHSNIQHFVEKVVFHLHESFPRPKRVCKDPPYKVEESGYAGFILPIEVYFKNKEEPRKVRFDYDLFLHLEGHPPVNHLRCEKLTFNNPTEDFRRKLLKAGGDPNRSIHTSSSSSSSSSSSSSSSSSSSSSSSSSSSSSSSSSSSSSSSSSSTSFSKPHKLMKEHKEKPSKDSREHKSAFKEPSRDHNKSSKESSKKPKENKPLKEEKIVPKMAFKEPKPMSKEPKPDSNLLTITSGQDKKAPSKRPPISDSEELSAKKRKKSSSEALFKSFSSAPPLILTCSADKKQIKDKSHVKMGKVKIESETSEKKKSTLPPFDDIVDPNDSDVEENISSKSDSEQPSPASSSSSSSSSFTPSQTRQQGPLRSIMKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHILQQIVNLIEETGHFHITNTTFDFDLCSLDKTTVRKLQSYLETSGTS

SEQ ID NO: 1115 - protein, 255 aa, Homo sapiens
  misc_feature (0)...(0): Polypeptide Accession Number P42655
MDDREDLVYQAKLAEQAERYDEMVESMKKVAGMDVELTVEERNLLSVAYKNVIGARRASWRIISSIEQKEENKGGEDKLKMIREYRQMVETELKLICCDILDVLDKHLIPAANTGESKVFYYKMKGDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEEQNKEALQDVEDENQ

SEQ ID NO: 1116 - protein, 397 aa, Homo sapiens
  misc_feature (0)...(0): Polypeptide Accession Number P42765
MRLLRGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLTVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 1117 - protein, 168 aa, Homo sapiens
  misc_feature (0)...(0): Polypeptide Accession Number P42773
MAEPWGNELASAAARGDLEQLTSLLQNNVNVNAQNGFGRTALQVMKLGNPEIARRLLLRGANPDLKDRTGFAVIHDAARAGFLDTLQTLLEFQADVNIEDNEGNLPLHLAAKEGHLRVVEFLVKHTASNVGHRNHKGDTACDLARLYGRNEVVSLMQANGAGGATNLQ

SEQ ID NO: 1118 - protein, 3144 aa, Homo sapiens
  misc_feature (0)...(0): Polypeptide Accession Number P42858
MATLEKLMKAFESLKSFQQQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSDTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSGWFDVLQKVSTQLKTNLTSVTKNRADKNAIHNHIRLFEPLVIKALKQYTTTTCVQLQKQVLDLLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGKELETQKEVVVSMLLRLIQYHQVLEMFILVLQQCHKENEDKWKRLSRQIADIILPMLAKQQMHIDSHEALGVLNTLFEILAPSSLRPVDMLLRSMFVTPNTMASVSTVQLWISGILAILRVLISQSTEDIVLSRIQELSFSPYLISCTVINRLRDGDSTSTLEEHSEGKQIKNLPEETFSRFLLQLVGILLEDIVTKQLKVEMSEQQHTFYCQELGTLLMCLIHIFKSGMFRRITAAATRLFRSDGCGGSFYTLDSLNLRARSMITTHPALVLLWCQILLLVNHTDYRWWAEVQQTPKRHSLSSTKLLSPQMSGEEEDSDLAAKLGMCNREIVRRGALILFCDYVCQNLHDSEHLTWLIVNHIQDLISLSHEPPVQDFISAVHRNSAASGLFIQAIQSRCENLSTPTMLKKTLQCLEGIHLSQSGAVLTLYVDRLLCTPFRVLARMVDILACRRVEMLLAANLQSSMAQLPMEELNRIQEYLQSSGLAQRHQRLYSLLDRFRLSTMQDSLSPSPPVSSHPLDGDGHVSLETVSPDKDWYVHLVKSQCWTRSDSALLEGAELVNRIPAEDMNAFMMNSEFNLSLLAPCLSLGMSEISGGQKSALFEAAREVTLARVSGTVQQLPAVHHVFQPELPAEPAAYWSKLNDLFGDAALYQSLPTLARALAQYLVVVSKLPSHLHLPPEKEKDIVKFVVATLEALSWHLIHEQIPLSLDLQAGLDCCCLALQLPGLWSVVSSTEFVTHACSLIYCVHFILEAVAVQPGEQLLSPERRTNTPKAISEEEEEVDPNTQNPKYITAACEMVAEMVESLQSVLALGHKRNSGVPAFLTPLLRNIIISLARLPLVNSYTRVPPLVWKLGWSPKPGGDFGTAFPEIPVEFLQEKEVFKEFIYRINTLGWTSRTQFEETWATLLGVLVTQPLVMEQEESPPEEDTERTQINVLAVQAITSLVLSAMTVPVAGNPAVSCLEQQPRNKPLKALDTRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMDKAVAEPVSRLLESTLRSSHLPSRVGALHGVLYVLECDLLDDTAKQLIPVISDYLLSNLKGIAHCVNIHSQQHVLVMCATAFYLIENYPLDVGPEFSASIIQMCGVMLSGSEESTPSIIYHCALRGLERLLLSEQLSRLDAESLVKLSVDRVNVHSPHRAMAALGLMLTCMYTGKEKVSPGRTSDPNPAAPDSESVIVAMERVSVLFDRIRKGFPCEARVVARILPQFLDDFFPPQDIMNKVIGEFLSNQQPYPQFMATVVYKVFQTLHSTGQSSMVRDWVMLSLSNFTQRAPVAMATWSLSCFFVSASTSPWVAAILPHVISRMGKLEQVDVNLFCLVATDFYRHQIEEELDRRAFQSVLEVVAAPGSPYHRLLTCLRNVHKVTTC

SEQ ID NO: 1119 - protein, 409 aa, Homo sapiens
  misc_feature (0)...(0): Polypeptide Accession Number P43034
VLSQRQRDELNRAIADYLRSNGYEEAYSVFKKEAELDVNEELDKKYAGLLEKKWTSVIRLQKKVMELESKLNEAKEEFTSGGPLGQKRDPKEWIPRPPEKYALSGHRSPVTRVIFHPVFSVMVSASEDATIKVWDYETGDFERTLKGHTDSVQDISFDHSGKLLASCSADMTIKLWDFQGFECIRTMHGHDHNVSSVAIMPNGDHIVSASRDKTIKMWEVQTGYCVKTFTGHREWVRMVRPNQDGTLIASCSNDQTVRVWVVATKECKAELREHEHVVECISWAPESSYSSISEATGSETKKSGKPGPFLLSGSRDKTIKMWDVSTGMCLMTLVGHDNWVRGVLFHSGGKFILSCADDKTLRVWDYKNKRCMKTLNAHEHFVTSLDFHKTAPYVVTGSVDQTVKVWECR

SEQ ID NO: 1120 - protein, 934 aa, Homo sapiens [sequence omitted]

SEQ ID NO: 1121 - protein, 201 aa, Homo sapiens
  misc_feature (0)...(0): Polypeptide Accession Number P43487
MAAAKDTHEDHDTSTENTDESNHDPQFEPIVSLPEQEIKTLEEDEEELFKMRAKLFRFASENDLPEWKERGTGDVKLLKHKEKGAIRLLMRRDKTLKICANHYITPMMELKPNAGSDRAWVWNTHADFADECPKPELLAIRFLNAENAQKFKTKFEECRKEIEEREKKAGSGKNDHAEKVAEKLEALSVKEETKEDAEEKQ

SEQ ID NO: 1122 - protein, 418 aa, Homo sapiens
  misc_feature (0)...(0): Polypeptide Accession Number P43686
MEEIGILVEKAQDEIPALSVSRPQTGLSFLGPEPEDLEDLYSRYKKLQQELEFLEVQEEYIKDEQKNLKKEFLHAQEEVKRIQSIPLVIGQFLEAVDQNTAIVGSTTGSNYYVRILSAIDRELLKPNASVALHKHSNALVDVLPPEADSSIMMLTSDQKPDVMYADIGGMDIQKQEVREAVELPLTHFELYKQIGIDPPRGVLMYGPPGCGKTMLAKAVAHHTTAAFIRVVGSEFVQKYLGEGPRMVRDVFRLAKENAPAIIFIDEIDAIATKRFDAQTGADREVQRILLELLNQMDGFDQNVNVKVIMATNRADTLDPALLRPGRLDRKIEFPLPDRRQKRLIFSTITSKMNLSEEVDLEDYVARPDKISGADINSICQESGMLAVRENRYIVLAKDFEKAYKTVIKKDEQEHEFYK

SEQ ID NO: 1123 - protein, 442 aa, Homo sapiens [sequence omitted]

SEQ ID NO: 1124 - protein, 287 aa, Homo sapiens
  misc_feature (0)...(0): Polypeptide Accession Number P45379
SDIEEVVEEYEEEEQEEAAVEEQEEAAEEDAEAEAETEETRAEEDEEEEEAKEAEDGPMEESKPKPRSFMPNLVPPKIPDGERVDFDDIHRKRMEKDLNELQALIEAHFENRKKEEEELVSLKDRIERRRAERAEQQRIRNEREKERQNRLAEERARREEEENRRKAEDEARKKKALSNMMHFGGYIQKQAQTERKSGKRQTEREKKKKILAERRKVLAIDHLNEDQLREKAKELWQSIYNLEAEKFDLQEKFKQQKYEINVLRNRINDNQKVSKTRGKAKVTGRWK

SEQ ID NO: 1125 - protein, 674 aa, Homo sapiens
  misc_feature (0)...(0): Polypeptide Accession Number P45844
MAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 1126 - protein, 212 aa, Homo sapiens
  misc_feature (0)...(0): Polypeptide Accession Number P45877
MGPGPRLLLPLVLCVGLGALVFSSGAEGFRKRGPSVTAKVFFDVRIGDKDVGRIVIGLFGKVVPKTVENFVALATGEKGYGYKGSKFHRVIKDFMIQGGDITTGDGTGGVSIYGETFPDENFKLKHYGIGWVSMANAGPDTNGSQFFITLTKPTWLDGKHVVFGKVIDGMTVVHSIELQATDGHDRPLTNCSIINSGKIDVKTPFVVEIADW

SEQ ID NO: 1127 - protein, 858 aa, Homo sapiens
  misc_feature (0)...(0): Polypeptide Accession Number P45974
MAELSEEALLSVLPTIRVPKAGDRVHKDECAFSFDTPESEGGLYICMNTFLGFGKQYVERHFNKTGQRVYLHLRRTRRPKEEDPATGTGDPPRKKPTRLAIGVEGGFDLSEEKFELDEDVKIVILPDYLEIARDGLGGLPDIVRDRVTSAVEALLSADSASRKQEVQAWDGEVRQVSKHAFSLKQLDNPARIPPCGWKCSKCDMRENLWLNLTDGSILCGRRYFDGSGGNNHAVEHYRETGYPLAVKLGTITPDGADVYSYDEDDMVLDPSLAEHLSHFGIDMLKMQKTDKTMTELEIDMNQRIGEWELIQESGVPLKPLFGPGYTGIRNLGNSCYLNSVVQVLFSIPDFQRKYVDKLEKIFQNAPTDPTQDFSTQVAKLGHGLLSGEYSKPVPESGDGERVPEQKEVQDGIAPRMFKALIGKGHPEFSTNRQQDAQEFFLHLINMVERNCRSSENPNEVFRFLVEEKIKCLATEKVKYTQRVDYIMQLPVPMDAALNKEELLEYEEKKRQAEEEKMALPELVRAQVPFSSCLEAYGAPEQVDDFWSTALQAKSVAVKTTRFASFPDYLVIQIKKFTFGLDWVPKKLDVSIEMPEELDISQLRGTGLQPGEEELPDIAPPLVTPDEPKGSLGFYGNEDEDSFCSPHFSSPTSPMLDESVIIQLVEMGFPMDACRKAVYYTGNSGAEAAMNWVMSHMDDPDFANPLILPGSSGPGSTSAAADPPPEDCVTTIVSMGFSRDQALKALRATNNSLERAVDWIFSHIDDLDAEAAMDISEGRSAADSISESVPVGPKVRDGPGKYQLFAFISHMGTSTMCGHYVCHIKKEGRWVIYNDQKVCASEKPPKDLGYIYFYQRVAS

SEQ ID NO: 1128 - protein, 424 aa, Homo sapiens [sequence omitted]

SEQ ID NO: 1129 - protein, 399 aa, Homo sapiens
  misc_feature (0)...(0): Polypeptide Accession Number P45985
MAAPSPSGGGGSGGGSGSGTPGPVGSPAPGHPAVSSMQGKRKALKLNFANPPFKSTARFTLNPNPTGVQNPHIERLRTHSIESSGKLKISPEQHWDFTAEDLKDLGEIGRGAYGSVNKMVHKPSGQIMAVKRIRSTVDEKEQKQLLMDLDVVMRSSDCPYIVQFYGALFREGDCWICMELMSTSFDKFYKYVYSVLDDVIPEEILGKITLATVKALNHLKENLKIIHRDIKPSNILLDRSGNIKLCDFGISGQLVDSIAKTRDAGCRPYMAPERIDPSASRQGYDVRSDVWSLGITLYELATGRFPYPKWNSVFDQLTQVVKGDPPQLSNSEEREFSPSFINFVNLCLTKDESKRPKYKELLKHPFILMYEERAVEVACYVCKILDQMPATPSSPMYVD

SEQ ID NO: 1130 - protein, 587 aa, Homo sapiens
  misc_feature (0)...(0): Polypeptide Accession Number P46060
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKILAAALTECHRKSSAQGKPLALKVFVAGRNRLENDGATALAEAFRVIGTLEEVHMPQNGINHPGITALAQAFAVNPLLRVINLNDNTFTEKGAVAMAETLKTLRQVEVINFGDCLVRSKGAVAIADAIRGGLPKLKELNLSFCEIKRDAALAVAEAMADKAELEKLDLNGNTLGEEGCEQLQEVLEGFNMAKVLASLSDDEDEEEEEEGEEEEEEAEEEEEEDEEEEEEEEEEEEEEPQQRGQGEKSATPSRKILDPNTGEPAPVLSSPPPADVSTFLAFPSPEKLLRLGPKSSVLIAQQTDTSDPEKVVSAFLKVSSVFKDEATVRMAVQDAVDALMQKAFNSSSFNSNTFLTRLLVHMGLLKSEDKVKAIANLYGPLMALNHMVQQDYFPKALAPLLLAFVTKPNSALESCSFARHSLLQTLYKV

SEQ ID NO: 1131 - protein, 2375 aa, Homo sapiens
  misc_feature (0)...(0): Polypeptide Accession Number P46100
MQSLPKGTVIVQPEPVLNEDKDDFKGPEFRSRSKMKTENLKKRGEDGLHGIVSCTACGQQVNHFQKDSIYRHPSLQVLICKNCFKYYMSDDISRDSDGMDEQCRWCAEGGNLICCDFCHNAFCKKCILRNLGRKELSTIMDENNQWYCYICHPEPLLDLVTACNSVFENLEQLLQQNKKKIKVDSEKSNKVYEHTSRFSPKKTSSNCNGEEKKLDDSCSGSVTYSYSALIVPKEMIKKAKKLIETTANMNSSYVKFLKQATDNSEISSATKLRQLKAFKSVLADIKKAHLALEEDLNSEFRAMDAVNKEKNTKEHKVIDAKFETKARKGEKPCALEKKDISKSEAKLSRKQVDSEHMHQNVPTEEQRTNKSTGGEHKKSDRKEEPQYEPANTSEDLDMDIVSVPSSVPEDIFENLETAMEVQSSVDHQGDGSSGTEQEVESSSVKLNISSKDNRGGIKSKTTAKVTKELYVKLTPVSLPNSPIKGADCQEVPQDKDGYKSCGLNPKLEKCGLGQENSDNEHLVENEVSLLLEESDLRRSPRVKTTPLRRPTETNPVTSNSDEECNETVKEKQKLSVPVRKKDKRNSSDSAIDNPKPNKLPKSKQSETVDQNSDSDEMLAILKGVSRMSHSSSSDTDINEIHTNHKTLYDLKTQAGKDDKGKRKRKSSTSGSDFDTKKGKSAKSSIISKKKRQTQSESSNYDSELEKEIKSMSKIGAARTTKKRIPNTKDFDSSEDEKHSKKGMDNQGHKNLKTSQEGSSDDAERKQERETFSSAEGTVDKDTTIMELRDRLPKKQQASASTDGVDKLSGKEQSFTSLEVRKVAETKEKSKHLKTKTCKKVQDGLSDIAEKFLKKDQSDETSEDDKKQSKKGTEEKKKPSDFKKKVIKMEQQYESSSDGTEKLPEREEICHFPKGIKQIKNGTTDGEKKSKKIRDKTSKKKDELSDYAEKSTGKGDSCDSSEDKKSKNGAYGREKKRCKLLGKSSRKRQDCSSSDTEKYSMKEDGCNSSDKRLKRIELRERRNLSSKRNTKEIQSGSSSSDAEESSEDNKKKKQRTSSKKKAVIVKEKKRNSLRTSTKRKQADITSSSSSDIEDDDQNSIGEGSSDEQKIKPVTENLVLSSHTGFCQSSGDEALSKSVPVTVDDDDDDNDPENRIAKKMLLEEIKANLSSDEDGSSDDEPEEGKKRTGKQNEENPGDEEAKNQVNSESDSDSEESKKPRYRHRLLRHKLTVSDGESGEEKKTKPKEHKEVKGRNRRKVSSEDSEDSDFQESGVSEEVSESEDEQRPRTRSAKKAELEENQRSYKQKKKRRRIKVQEDSSSENKSNSEEEEEEKEEEEEEEEEEEEEEEDENDDSKSPGKGRKKIRKILKDDKLRTETQNALKEEEERRKRIAEREREREKLREVIEIEDASPTKCPITTKLVLDEDEETKEPLVQVHRNMVIKLKPHQVDGVQFMWDCCCESVKKTKKSPGSGCILAHCMGLGKTLQVVSFLHTVLLCDKLDFSTALVVCPLNTALNWMNEFEKWQEGLKDDEKLEVSELATVKRPQERSYMLQRWQEDGGVMIIGYEMYRNLAQGRNVKSRKLKEIFNKALVDPGPDFVVCDEGHILKNEASAVSKAMNSIRSRRRIILTGTPLQNNLIEYHCMVNFIKENLLGSIKEFRNRFINPIQNGQCADSTMVDVRVMKKRAHILYEMLAGCVQRKDYTALTKFLPPKHEYVLAVRMTSIQCKLYQYYLDHLTGVGNNSEGGRGKAGAKLFQDFQMLSRIWTHPWCLQLDYISKENKGYFDEDSMDEFIASDSDETSMSLSSDDYTKKKKKGKKGKKDSSSSGSGSDNDVEVIKVWNSRSRGGGEGNVDETGNNPSVSLKLEESKATSSSNPSSPAPDWYKDFVTDADAEVLEHSGKMVLLFEILRMAEEIGDKVLVFSQSLISLDLIEDFLELASREKTEDKDKPLIYKGEGKWLRNIDYYRLDGSTTAQSRKKWAEEFNDETNVRGRLFIISTKAGSLGINLVAANRVIIFDASWNPSYDIQSIFRVYRFGQTKPVYVYRFLAQGTMEDKIYDRQVTKQSLSFRVVDQQQVERHFTMNELTELYTFEPDLLDDPNSEKKKKRDTPMLPKDTILAELLQIHKEHIVGYHEHDSLLDHKEEEELTEEERKAAWAEYEAEKKVLTMRFNIPTGTNLPPVSFNSQTPYIPFNLGALSAMSNQQLEDLINQGREKVVEATNSVTAVRIQPLEDIISAVWKENMNLSEAQVQALALSRQASQELDVKRREAIYNDVLTKQQMLISCVQRILMNRRLQQQYNQQQQQQMTYQQATLGHLMMPKPPNLIMNPSNYQQIDMRGMYQPVAGGMQPPPLQRAPPPMRSKNPGPSQGKSM

SEQ ID NO: 1132 - protein, 304 aa, Homo sapiens
  misc_feature (0)...(0): Polypeptide Accession Number P46108
MAGNFDSEERSSWYWGRLSRQEAVALLQGQRHGVFLVRDSSTSPGDYVLSVSENSRVSHYIINSSGPRPPVPPSPAQPPPGVSPSRLRIGDQEFDSLPALLEFYKIHYWDTTTLIEPVSRSRQGSGVILRQEEAEYVRALFDFNGNDEEDLPFKKGDILRIRDKPEEQWWNAEDSEGKRGMIPVPYVEKYRPASASVSALIGGNQEGSHPQPLGPPEPGPYAQPSVNTPLPNLQNGPIYARVIQKRVPNAYDKTALALEVGELVKVTKINVSGQWEGGCNGKRGHFPFTHVRLLDQQNPDEDFS

SEQ ID NO: 1133 - protein, 303 aa, Homo sapiens
  misc_feature (0)...(0): Polypeptide Accession Number P46109
MSSARFDSSDRSAWYMGPVSRQEAQTRLQGQRHGMFLVRDSSTCPGDYVLSVSENSRVSHYIINSLPNRRFKIGDQEFDHLPALLEFYKIHYLDTTTLIEPAPRYPSPPMGSVSAPNLPTAEDNLEYVRTLYDFPGNDAEDLPFKKGEILVIIEKPEEQWWSARNKDGRVGMIPVPYVEKLVRSSPHGKHGNRNSNSYGIPEPAHAYAQPQTTTPLPAVSGSPGAAITPLPSTQNGPVFAKAIQKRVPCAYDKTALALEVGDIVKVTRMNINGQWEGEVNGRKGLFPFTHVKIFDPQNPDENE

SEQ ID NO: 1134 - protein, 318 aa, Homo sapiens [sequence omitted]

SEQ ID NO: 1135 - protein, 2468 aa, Homo sapiens
  misc_feature (0)...(0): Polypeptide Accession Number P46821
MATVVVEATEPEPSGSIANPAASTSPSLSHRFLDSKFYLLVVVGEIVTEEHLRRAIGNIELGIRSWDTNLIECNLDQELKLFVSRHSARFSPEVPGQKILHHRSDVLETVVLINPSDEAVSTEVRLMITDAARHKLLVLTGQCFENTGELILQSGSFSFQNFIEIFTDQEIGELLSTTHPANKASLTLFCPEEGDWKNSNLDRHNLQDFINIKLNSASILPEMEGLSEFTEYLSESVEVPSPFDILEPPTSGGFLKLSKPCCYIFPGGRGDSALFAVNGFNMLINGGSERKSCFWKLIRHLDRVDSILLTHIGDDNLPGINSMLQRKIAELEEEQSQGSTTNSDWMKNLISPDLGVVFLNVPENLKNPEPNIKMKRSIEEACFTLQYLNKLSMKPEPLFRSVGNTIDPVILFQKMGVGKLEMYVLNPVKSSKEMQYFMQQWTGTNKDKAEFILPNGQEVDLPISYLTSVSSLIVWHPANPAEKIIRVLFPGNSTQYNILEGLEKLKHLDFLKQPLATQKDLTGQVPTPVVKQTKLKQRADSRESLKPAAKPLPSKSVRKESKEETPEVTKVNHVEKPPKVESKEKVMVKKDKPVKTETKPSVTEKEVPSKEEPSPVKAEVAEKQATDVKPKAAKEKTVKKETKVKPEDKKEEKEKPKKEVAKKEDKTPIKKEEKPKKEEVKKEVKKEIKKEEKKEPKKEVKKETPPKEVKKEVKKEEKKEVKKEEKEPKKEIKKLPKDAKKSSTPLSEAKKPAALKPKVPKKEESVKKDSVAAGKPKEKGKIKVIKKEGKAAEAVAAAVGTGATTAAVMAAAGIAAIGPAKELEAERSLMSSPEDLTKDFEELKAEEVDVTKDIKPQLELIEDEEKLKETEPVEAYVIQKEREVTKGPAESPDEGITTTEGEGECEQTPEELEPVEKQGVDDIEKFEDEGAGFEESSETGDYEEKAETEEAEEPEEDGEEHVCVSASKHSPTEDEESAKAEADAYIREKRESVASGDDRAEEDMDEAIEKGEAEQSEEEADEEDKAEDAREEEYEPEKMEAEDYVMAVVDKAAEAGGAEEQYGFLTTPTKQLGAQSPGREPASSIHDETLPGGSESEATASDEENREDQPEEFTATSGYTQSTIEISSEPTPMDEMSTPRDVMSDETNNEETESPSQEFVNITKYESSLYSQEYSKPADVTPLNGFSEGSKTDATDGKDYNASASTISPPSSMEEDKFSRSALRDAYCSEVKASTTLDIKDSISAVSSEKVSPSKSPSLSPSPPSPLEKTPLGERSVNFSLTPNEIKVSAEAEVAPVSPEVTQEVVEEHCASPEDKTLEVVSPSQSVTGSAGHTPYYQSPTDEKSSHLPTEVIEKPPAVPVSFEFSDAKDENERASVSPMDEPVPDSESPIEKVLSPLRSPPLIGSESAYESFLSADDKASGRGAESPFEEKSGKQGSPDQVSPVSEMTSTSLYQDKQEGKSTDFAPIKEDFGQEKKTDDVEAMSSQPALALDERKLGDVSPTQIDVSQFGSFKEDTKMSISEGTVSDKSATPVDEGVAEDTYSHMEGVASVSTASVATSSFPEPTTDDVSPSLHAEVGSPHSTEVDDSLSVSVVQTPTTFQETEMSPSKEECPRPMSISPPDFSPKTAKSRTPVQDHRSEQSSMSIEFGQESPEQSLAMDFSRQSPDHPTVGAGVLHITENGPTEVDYSPSDMQDSSLSHKIPPMEEPSYTQDNDLSELISVSQVEASPSTSSAHTPSQIASPLQEDTLSDVAPPRDMSLYASLTSEKVQSLEGEKLSPKSDISPLTPRESSPLYSPTFSDSTSAVKEKTATCHSSSSPPIDAASAEPYGFRASVLFDTMQHHLALNRDLSTPGLEKDSGGKTPGDFSYAYQKPEETTRSPDEEDYDYESYEKTTRTSDVGGYYYEKIERTTKSPSDSGYSYETIGKTTKTPEDGDYSYEIIEKTTRTPEEGGYSYDISEKTTSPPEVSGYSYEKTERSRRLLDDISNGYDDSEDGGHTLGDPSYSYETTEKITSFPESEGYSYETSTKTTRTPDTSTYCYETAEKITRTPQASTYSYETSDLCYTAEKKSPSEARQDVDLCLVSSCEYKHPKTELSPSFINPNPLEWFASEEPTEESEKPLTQSGGAPPPPGGKQQGRQCDETPPTSVSESAPSQTDSDVPPETEECPSITADANIDSEDESETIPTDKTVTYKHMDPPPAPVQDRSPSPRHPDVSMVDPEALAIEQNLGKALKKDLKEKTKTKKPGTKTKSSSPVKKSDGKSKPLAASPKPAGLKESSDKVSRVASPKKKESVEKAAKPTTTPEVKAARGEEKDKETKNAANASASKSAKTATAGPGTTKTTKSSAVPPGLPVYLDLCYIPNHSNSKNVDVEFFKRVRSSYYVVSGNDPAAEEPSRAVLDALLEGKAQWGSNMQVTLIPTHDSEVMREWYQETHEKQQDLNIMVLASSSTVVMQDESFPACKIEL

SEQ ID NO: 1136 - protein, 3433 aa, Homo sapiens
  misc_feature (0)...(0): Polypeptide Accession Number P46939
MAKYGEHEASPDNGQNEFSDIIKSRSDEHNDVQKKTFTKWINARFSKSGKPPINDMFTDLKDGRKLLDLLEGLTGTSLPKERGSTRVHALNNVNRVLQVLHQNNVELVNIGGTDIVDGNHKLTLGLLWSIILHWQVKDVMKDVMSDLQQTNSEKILLSWVRQTTRPYSQVNVLNFTTSWTDGLAFNAVLHRHKPDLFSWDKVVKMSPIERLEHAFSKAQTYLGIEKLLDPEDVAVRLPDKKSIIMYLTSLFEVLPQQVTIDAIREVETLPRKYKKECEEEAINIQSTAPEEEHESPRAETPSTVTEVDMDLDSYQIALEEVLTWLLSAEDTFQEQDDISDDVEEVKDQFATHEAFMMELTAHQSSVGSVLQAGNQLITQGTLSDEEEFEIQEQMTLLNARWEALRVESMDRQSRLHDVLMELQKKQLQQLSAWLTLTEERIQKMETCPLDDDVKSLQKLLEEHKSLQSDLEAEQVKVNSLTHMVVIVDENSGESATAILEDQLQKLGERWTAVCRWTEERWNRLQEINILWQELLEEQCLLKAWLTEKEEALNKVQTSNFKDQKELSVSVRRLAILKEDMEMKRQTLDQLSEIGQDVGQLLDNSKASKKINSDSEELTQRWDSLVQRLEDSSNQVTQAVAKLGMSQIPQKDLLETVRVREQAITKKSKQELPPPPPPKKRQIHVDIEAKKKFDAISAELLNWILKWKTAIQTTEIKEYMKMQDTSEMKKKLKALEKEQRERIPRADELNQTGQILVEQMGKEGLPTEEIKNVLEKVSSEWKNVSQHLEDLERKIQLQEDINAYFKQLDELEKVIKTKEEWVKHTSISESSRQSLPSLKDSCQRELTNLLGLHPKIEMARASCSALMSQPSAPDFVQRGFDSFLGRYQAVQEAVEDRQQHLENELKGQPGHAYLETLKTLKDVLNDSENKAQVSLNVLNDLAKVEKALQEKKTLDEILENQKPALHKLAEETKALEKNVHPDVEKLYKQEFDDVQGKWNKLKVLVSKDLHLLEEIALTLRAFEADSTVIEKWMDGVKDFLMKQQAAQGDDAGLQRQLDQCSAFVNEIETIESSLKNMKEIETNLRSGPVAGIKTWVQTRLGDYQTQLEKLSKEIATQKSRLSESQEKAANLKKDLAEMQEWMTQAEEEYLERDFEYKSPEELESAVEEMKRAKEDVLQKEVRVKILKDNIKLLAAKVPSGGQELTSELNVVLENYQLLCNRIRGKCHTLEEVWSCWIELLHYLDLETTWLNTLEERMKSTEVLPEKTDAVNEALESLESVLRHPADNRTQIRELGQTLIDGGILDDIISEKLEAFNSRYEDLSHLAESKQISLEKQLQVLRETDQMLQVLQESLGELDKQLTTYLTDRIDAFQVPQEAQKIQAEISAHELTLEELRRNMRSQPLTSPESRTARGGSQMDVLQRKLREVSTKFQLFQKPANFEQRMLDCKRVLDGVKAELHVLDVKDVDPDVIQTHLDKCMKLYKTLSEVKLEVETVIKTGRHIVQKQQTDNPKGMDEQLTSLKVLYNDLGAQVTEGKQDLERASQLARKMKKEAASLSEWLSATETELVQKSTSEGLLGDLDTEISWAKNVLKDLEKRKADLNTITESSAALQNLIEGSEPILEERLCVLNAGWSRVRTWTEDWCNTLMNHQNQLEIFDGNVAHISTWLYQAEALLDEIEKKPTSKQEEIVKRLVSELDDANLQVENVRDQALILMNARGSSSRELVEPKLAELNRNFEKVSQHIKSAKLLIAQEPLYQCLVTTETFETGVPFSDLEKLENDIENMLKFVEKHLESSDEDEKMDEESAQIEEVLQRGEEMLHQPMEDNKKEKIRLQLLLLHTRYNKIKAIPIQQRKMGQLASGIRSSLLPTDYLVEINKILLCMDDVELSLNVPELNTAIYEDFSFQEDSLKNIKDQLDKLGEQIAVIHEKQPDVILEASGPEAIQIRDTLTQLNAKWDRINRMYSDRKGCFDRAMEEWRQFHCDLNDLTQWITEAEELLVDTCAPGGSLDLEKARIHQQELEVGISSHQPSFAALNRTGDGIVQKLSQADGSFLKEKLAGLNQRWDAIVAEVKDRQPRLKGESKQVMKYRHQLDEIICWLTKAEHAMQKRSTTELGENLQELRDLTQEMEVHAEKLKWLNRTELEMLSDKSLSLPERDKISESLRTVNMTWNKICREVPTTLKECIQEPSSVSQTRIAAHPNVQKVVLVSSASDIPVQSHRTSEISIPADLDKTITELADWLVLIDQMLKSNIVTVGDVEEINKTVSRMKITKADLEQRHPQLDYVFTLAQNLKNKASSSDMRTAITEKLERVKNQWDGTQHGVELRQQQLEDMIIDSLQWDDHREETEELMRKYEARLYILQQARRDPLTKQISDNQILLQELGPGDGIVMAFDNVLQKLLEEYGSDDTRNVKETTEYLKTSWINLKQSIADRQNALEAEWRTVQASRRDLENFLKWIQEAETTVNVLVDASHRENALQDSILARELKQQMQDIQAEIDAHNDIFKSIDGNRQKMVKALGNSEEATMLQHRLDDMNQRWNDLKAKSASIRAHLEASAEKWNRLLMSLEELIKWLNMKDEELKKQMPIGGDVPALQLQYDHCKALRRELKEKEYSVLNAVDQARVFLADQPIEAPEEPRRNLQSKTELTPEERAQKIAKAMRKQSSEVKEKWESLNAVTSNWQKQVDKALEKLRDLQGAMDDLDADMKEAESVRNGWKPVGDLLIDSLQDHIEKIMAFREEIAPINFKVKTVNDLSSQLSPLDLHPSLKMSRQLDDLNMRWKLLQVSVDDRLKQLQEAHRDFGPSSQHFLSTSVQLPWQRSISHNKVPYYINHQTQTTCWDHPKMTELFQSLADLNNVRFSAYRTAIKIRRLQKALCLDLLELSTTNEIFKQHKLNQNDQLLSVPDVINCLTTTYDGLEQMHKDLVNVPLCVDMCLNWLLNVYDTGRTGKIRVQSLKIGLMSLSKGLLEEKYRYLFKEVAGPTEMCDQRQLGLLLHDAIQIPRQLGEVAAFGGSNIEPSVRSCFQQNNNKPEISVKEFIDWMHLEPQSMVWLPVLHRVAAAETAKHQAKCNICKECPIVGFRYRSLKHFNYDVCQSCFFSGRTAKGHKLHYPMVEYCIPTTSGEDVRDFTKVLKNKFRSKKYFAKHPRLGYLPVQTVLEGDNLETPITLISMWPEHYDPSQSPQLFHDDTHSRIEQYATRLAQMERTNGSFLTDSSSTTGSVEDEHALIQQYCQTLGGESPVSQPQSPAQILKSVEREERGELERIIADLEEEQRNLQVEYEQLKDQHLRRGLPVGSPPESIISPHHTSEDSELIAEAKLLRQHKGRLEARMQILEDHNKQLESQLHRLRQLLEQPESDSRINGVSPWASPQHSALSYSLDPDASGPQFHQAAGEDLLAPPHDTSTDLTEVMEQIHSTFPSCCPNVPSRPQAM

SEQ ID NO: 1137 - protein, 349 aa, Homo sapiens
  misc_feature (0)...(0): Polypeptide Accession Number P46976
TDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDIRKHLPFIYNLSSISIYSYLPAFKVFGASAKVVHFLGRVKPWNYTYDPKTKSVKSEAHDPNMTHPEFLILWWNIFTTNVLPLLQQFGLVKDTCSYVNVLSDLVYTLAFSCGFCRKEDVSGAISHLSLGEIPAMAQPFVSSEERKERWEQGQADYMGADSFDNIKRKLDTYLQ

SEQ ID NO: 1138 - protein, 406 aa, Homo sapiens [sequence omitted]

SEQ ID NO: 1139 - protein, 512 aa, Homo sapiens
  misc_feature (0)...(0): Polypeptide Accession Number P47895
MATANGAVENGQPDGKPPALPRPIRNLEVKFTKIFINNEWHESKSGKKFATCNPSTREQICEVEEGDKPDVDKAVEAAQVAFQRGSPWRRLDALSRGRLLHQLADLVERDRATLAALETMDTGKPFLHAFFIDLEGCIRTLRYFAGWADKIQGKTIPTDDNVVCFTRHEPIGVCGAITPWNFPLLMLVWKLAPALCCGNTMVLKPAEQTPLTALYLGSLIKEAGFPPGVVNIVPGFGPTVGAAISSHPQINKIAFTGSTEVGKLVKEAASRSNLKRVTLELGGKNPCIVCADADLDLAVECAHQGVFFNQGQCCTAASRVFVEEQVYSEFVRRSVEYAKKRPVGDPFDVKTEQGPQIDQKQFDKILELIESGKKEGAKLECGGSAMEDKGLFIKPTVFSEVTDNMRIAKEEIFGPVQPILKFKSIEEVIKRANSTDYGLTAAVFTKNLDKALKLASALESGTVWINCYNALYAQAPFGGFKMSGNGRELGEYALAEYTEVKTVTIKLGDKNP

SEQ ID NO: 1140 - protein, 482 aa, Homo sapiens
  misc_feature (0)...(0): Polypeptide Accession Number P47974
MSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPDLYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPDSSLSSGSLSGSESPSLDPGRRLPIFSRLSISDD

SEQ ID NO: 1141 - protein, 147 aa, Homo sapiens
  misc_feature (0)...(0): Polypeptide Accession Number P47986
MALKRINKELSDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDRDKYNRISREWTQKYAM

SEQ ID NO: 1142 - protein, 2142 aa, Homo sapiens
  misc_feature (0)...(0): Polypeptide Accession Number P48634
MSDRSGPTAKGKDGKKYSSLNLFDTYKGKSLEIQKPACCPSPWPAESRESCHCPAYRPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPETEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLEFYPPGVHPSGLVPRERSDSLGLSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKLPASRSGAGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGGQANSAVTESFEEMMGVEVGQGDQTTLLLPEAAMPARHGARVQSMRKSPSGAGSGAQKQAARPMRVIWLLQTRRLPHPRREHSPRSSRSPTTRSPTLHRAPARFTCPGVGESSLPEGAISPGPRRREAPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPPRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPTSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGSHGLSITSKQWRLRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 1143 - protein, 1618 aa, Homo sapiens
  misc_feature (0)...(0): Polypeptide Accession Number P48681
MEGCMGEESFQMWELNRRLEAYLGRVKALEEQNELLSAGLGGLRRQSADTSWRAHADDELAALRALVDQRWREKHAAEVARDNLAEELEGVAGRCEQLRLARERTTEEVARNRRAVEAEKCARAWLSSQGAELERELEALRVAHEEERVGLNAQAACAPRLPAPPRPPAPAPEVEELARRLGEAWRGAVRGYQERVAHMETSLDQTRERLARAVQGAREVRLELQQLQAERGGLLERRAALEQRLEGRWQERLRATEKFQLAVEALEQEKQGLQSQIAQVLEGRQQLAHLKMSLSLEVATYRTLLEAENSRLQTPGGGSKTSLSFQDPKLELQFPRTPEGRRLGSLLPVLSPTSLPSPLPATLETPVPAFLKNQEFLQARTPTLASTPIPPTPQAPSPAVDAEIRAQDAPLSLLQTQGGRKQAPEPLRAEARVAIPASVLPGPEEPGGQRQEASTGQSPEDHASLAPPLSPDHSSLEAKDGESGGSRVFSICRGEGEGQIWGLVEKETAIEGKVVSSLQQEIWEEEDLNRKEIQDSQVPLEKETLKSLGEEIQESLKTLENQSHETLERENQECPRSLEEDLETLKSLEKENKRAIKGCGGSETSRKRGCRQLKPTGKEDTQTLQSLQKENQELMKSLEGNLETFLFPGTENQELVSSLQENLESLTALEKENQEPLRSPEVGDEEALRPLTKENQEPLRSLEDENKEAFRSLEKENQEPLKTLEEEDQSIVRPLETENHKSLRSLEEQDQETLRTLEKETQQRRRSLGEQDQMTLRPPEKVDLEPLKSLDQEIARPLENENQEFLKSLKEESVEAVKSLETEILESLKSAGQENLETLKSPETQAPLWTPEEINKSGGNESSRKGNSRTTGVCGSEPRDIQTPGRGESGIIEISGSMEPGEFEISRGVDKESQRNLEEEENLGKGEYQESLRSLEEEGQELPQSADVQRWEDTVEKDQELAQESPPGMAGVENKDEAELNLREQDGFTGKEEVVEQGELNATEEVWFPGEGHPENPEPKEQRGLVEGASVKGGAEGLQDPEGQSQQVGTPGLQAPQGLPEAIEPLVEDDVAPGGDQASPEVMLGSEPAMGESAAGAEPGLGQGVGGLGDPGHLTREEVMEPPLEEESLEAKRVQGLEGPRKDLEEAGGLGTEFSELPGKSRDPWEPPREGREESEAEAPRGAEEAFPAETLGHTGSDAPSPWPLGSEEAEEDVPPVLVSPSPTYTPILEDAPGLQPQAEGSQEASWGVQGRAEAGKVESEQEELGSGEIPEGLQEEGEESREESEEDELGETLPDSTPLGFYLRSPTSPRWTPLESRGHPLKETGKEGWDPAVLASEGLEEPSEKEEGEEGEEECGRDSDLSEEFEDLGTEAPFLPGVPGEVAEPLGQVPQLLLDPAAWDRDGESDGFADEEESGEEGEEDQEEGREPGAGRWGPGSSVGSLQALSSSQRGEFLESDSVSVSVPWDDSLRGAVAGAPKTALETESQDSAEPSGSEEESDPVSLEREDKVPGPLEIPSGMEDAGPGADIIGVNGQGPNLEGKSQHVNGGVMNGLEQSEESGARNALVSEGDRGSPFQEEEGSALKRSSAGAPVHLGQGQFLKFTQREGDRESWSSGED

SEQ ID NO: 1144 - protein, 337 aa, Homo sapiens
  misc_feature (0)...(0): Polypeptide Accession Number P48729
MASSSGSKAEFIVGGKYKLVRKIGSGSFGDIYLAINITNGEEVALKLESQKARHPQLLYESKLYKILQGGVGIPHIRWYGQEKDYNVLVMDLLGPSLEDLFNFCSRRFTMKTVLMLADQMISRIEYVHTKNFIHRDIKPDNFLMGIGRHCNKLFLIDFGLAKKYRDNRTRQHIPYREDKNLTGTARYASINAHLGIEQSRRDDMESLGYVLMYFNRTSLPWQGLKAATKKQKYEKISEKKMSTPVEVLCKGFPAEFAMYLNYCRGLRFEEAPDYMYLRQLFRILFRTLNHQYDYTFDWTMLKQKAAQQAASSSGQGQQAQTPTGKQTDKSKSNMKGF

SEQ ID NO: 1145 - protein, 415 aa, Homo sapiens
  misc_feature (0)...(0): Polypeptide Accession Number P48730
MELRVGNRYRLGRKIGSGSFGDIYLGTDIAAGEEVAIKLECVKTKHPQLHIESKIYKMMQGGVGIPTIRWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFATYLNFCRSLRFDDKPDYSYLRQLFRNLFHRQGFSYDYVFDWNMLKFGASRAADDAERERRDREERLRHSRNPATRGLPSTDSGRLRGTQEVAPPTPLTPTSHTANTSPRPVSGMERERKVSMRLHRGAPVNISSSDLTGRQDTSRMSTSQIPGRVASSGLQSVVHR

SEQ ID NO: 1146 - protein, 400 aa, Homo sapiens
  misc_feature (0)...(0): Polypeptide Accession Number P49137
MLSNSQGQSPPVPFPAPAPPPQPPTPALPHPPAQPPPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKEEMTSALATMRVDYEQIKIKKIEDASNPLLLKRRKKARALEAAALAH

SEQ ID NO: 1147 - protein, 493 aa, Homo sapiens [sequence omitted]

SEQ ID NO: 1148 - protein, 787 aa, Homo sapiens [sequence omitted]

SEQ ID NO: 1149 - protein, 379 aa, Homo sapiens
  misc_feature (0)...(0): Polypeptide Accession Number P49354
MAATEGVGEAAQGGEPGQPAQPPPQPHPPPPQQQHKEEMAAEAGEAVASPMDDGFVSLDSPSYVLYRDRAEWADIDPVPQNDGPNPVVQIIYSDKFRDVYDYFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQEFKLWDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 1150 - protein, 437 aa, Homo sapiens
  misc_feature (0)...(0): Polypeptide Accession Number P49356
MASPSSFTYYCPPSSSPVWSEPLYSLRPEHARERLQDDSVETVTSIEQAKVEEKIQEVFSSYKFNHLVPRLVLQREKHFHYLKRGLRQLTDAYECLDASRPWLCYWILHSLELLDEPIPQIVATDVCQFLELCQSPEGGFGGGPGQYPHLAPTYAAVNALCIIGTEEAYDIINREKLLQYLYSLKQPDGSFLMHVGGEVDVRSAYCAASVASLTNIITPDLFEGTAEWIARCQNWEGGIGGVPGMEAHGGYTFCGLAALVILKRERSLNLKSLLQWVTSRQMRFEGGFQGRCNKLVDGCYSFWQAGLLPLLHRALHAQGDPALSMSHWMFHQQALQEYILMCCQCPAGGLLDKPGKSRDFYHTCYCLSGLSIAQHFGSGAMLHDVVLGVPENALQPTHPVYNIGPDKVIQATTYFLQKPVPGFEELKDETSAEPATD

SEQ ID NO: 1151 - protein, 544 aa, Homo sapiens
  misc_feature (0)...(0): Polypeptide Accession Number P49368
MGHRPVLVLSQNTKRESGRKVQSGNINAAKTIADIIRTCLGPKSMMKMLLDPMGGIVMTNDGNAILREIQVQHPAAKSMIEISRTQDEEVGDGTTSVIILAGEMLSVAEHFLEQQMHPTVVISAYRKALDDMISTLKKISIPVDISDSDMMLNIINSSITTKAISRWSSLACNIALDAVKMVQFEENGRKEIDIKKYARVEKIPGGIIEDSCVLRGVMINKDVTHPRMRRYIKNPRIVLLDSSLEYKKGGSQTDIEITREEDFTRILQMEEEYIQQLCEDIIQLKPDVVITEKGISDLAQHYLMRANITAIRRVRKTDNNRIARACGARIVSRPEELREDDVGTGAGLLEIKKIGDEYFTFITDCKDPKACTILLRGASKEILSEVERNLQDAMQVCRNVLLDPQLVPGGGASEMAVAHALTEKSKAMTGVEQWPYRAVAQALEVIPRTLIQNCGASTIRLLTSLRAKHTQENCETWGVNGETGTLVDMKELGIWEPLAVKLQTYKTAVETAVLLLRIDDIVSGHKKKGDDQSRQGGAPDAGQE

SEQ ID NO: 1152 - protein, 695 aa, Homo sapiens
  misc_feature (0)...(0): Polypeptide Accession Number P49418
MADIKTGIFAKNVQKRLNRAQEKVLQKLGKADETKDEQFEEYVQNFKRQEAEGTRLQRELRGYLAAIKGMQEASMKLTESLHEVYEPDWYGREDVKMVGEKCDVLWEDFHQKLVDGSLLTLDTYLGQFPDIKNRIAKRSRKLVDYDSARHHLEALQSSKRKDESRISKAEEEFQKAQKVFEEFNVDLQEELPSLWSRRVGFYVNTFKNVSSLEAKFHKEIAVLCHKLYEVMTKLGDQHADKAFTIQGAPSDSGPLRIAKTPSPPEEPSPLPSPTASPNHTLAPASPAPARPRSPSQTRKGPPVPPLPKVTPTKELQQENIISFFEDNFVPEISVTTPSQNEVPEVKKEETLLDLDFDPFKPEVTPAGSAGVTHSPMSQTLPWDLWTTSTDLVQPASGGSFNGFTQPQDTSLFTMQTDQSMICNLAESEQAPPTEPKAEEPLAAVTPAVGLDLGMDTRAEEPVEEAVIIPGADADAAVGTLVSAAEGAPGEEAEAEKATVPAGEGVSLEEAKIGTETTEGAESAQPEAEELEATVPQEKVIPSVVIEPASNHEEEGENEITIGAEPKETTEDAAPPGPTSETPELATEQKPIQDPQPTPSAPAMGAADQLASAREASQELPPGFLYKVETLHDFEAANSDELTLQRGDVVLVVPSDSEADQDAGWLVGVKESDWLQYRDLATYKGLFPENFTRRLD

SEQ ID NO: 1153 - protein, 558 aa, Homo sapiens
  misc_feature (0)...(0): Polypeptide Accession Number P49448
MYRYLAKALLPSRAGPAALGSAANHSAALLGRGRGQPAAASQPGLALAARRHYSELVADREDDPNFFKMVEGFFDRGASIVEDKLVKDLRTQESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTENELEKITRRFTMELAKKGFIGPGVDVPAPDMNTGEREMSWIADTYASTIGHYDINAHACVTGKPISQGGIHGRISATGRGVFHGIENFINEASYMSILGMTPGFRDKTFVVQGFGNVGLHSMRYLHRFGAKCIAVGESDGSIWNPDGIDPKELEDFKLQHGSILGFPKAKPYEGSILEVDCDILIPAATEKQLTKSNAPRVKAKIIAEGANGPTTPEADKIFLERNILVIPDLYLNAGGVTVSYFEWLKNLNHVSYGRLTFKYERDSNYHLLLSVQESLERKFGKHGGTIPIVPTAEFQDSISGASEKDIVHSALAYTMERSARQIMHTAMKYNLGLDLRTAAYVNAIEKVFKVYSEAGVTFT

SEQ ID NO: 1154 - protein, 3210 aa, Homo sapiens
  misc_feature (0)...(0): Polypeptide Accession Number P49454
MSWALEEWKEGLPTRTLQKIQELEGQLDKLKKEKQQRQFQLDSLEAAPQKQTQKVENEKTEGTNLKRENQRLMEICESLEKTKQKISHELQVKESQVNFQEGQLNSGKKQIEKLEQELKRCKSELERSQQAAQSADVSLNPCNTPQKIFTTPLTPSQYYSGSKYEDLKEKYNKEVEERKRLEAEVKALQAKKASQTLPQATMNHRDIARHQASSSVFSWQQEKTPSHLSSNSQRTPIRRDFSASYFSGELEVTPSRSTLQIGKRDANSSFFGNSSSPHLLDQLKAQNQELRNKINELELRLQGHEKEMKGQVNKFQELQLQLEKAKVELIEKEKVLNKCRDELVRTTAQYDQASTKYTALEQKLKKLTEDLSCQRQNAESARCSLEQKIKEKEKEFQEELSRQQRSFQTLDQECIQMKARLTQELQQAKNMHNVLQAELDKLTSVKQQLENNLEEFKQKLCRAEQAFQASQIKENELRRSMEEMKKENNLLKSHSEQKAREVCHLEAELKNIKQCLNQSQNFAEEMKAKNTSQETMLRDLQEKINQQENSLTLEKLKLAVADLEKQRDCSQDLLKKREHHIEQLNDKLSKTEKESKALLSALELKKKEYEELKEEKTLFSCWKSENEKLLTQMESEKENLQSKINHLETCLKTQQIKSHEYNERVRTLEMDRENLSVEIRNLHNVLDSKSVEVETQKLAYMELQQKAEFSDQKHQKEIENMCLKTSQLTGQVEDLEHKLQLLSNEIMDKDRCYQDLHAEYESLRDLLKSKDASLVTNEDHQRSLLAFDQQPAMHHSFANIIGEQGSMPSERSECRLEADQSPKNSAILQNRVDSLEFSLESQKQMNSDLQKQCEELVQIKGEIEENLMKAEQMHQSFVAETSQRISKLQEDTSAHQNVVAETLSALENKEKELQLLNDKVETEQAEIQELKKSNHLLEDSLKELQLLSETLSLEKKEMSSIISLNKREIEELTQENGTLKEINASLNQEKMNLIQKSESFANYIDEREKSISELSDQYKQEKLILLQRCEETGNAYEDLSQKYKAAQEKNSKLECLLNECTSLCENRKNELEQLKEAFAKEHQEFLTKLAFAEERNQNLMLELETVQQALRSEMTDNQNNSKSEAGGLKQEIMTLKEEQNKMQKEVNDLLQENEQLMKVMKTKHECQNLESEPIRNSVKERESERNQCNFKPQMDLEVKEISLDSYNAQLVQLEAMLRNKELKLQESEKEKECLQHELQTIRGDLETSNLQDMQSQEISGLKDCEIDAEEKYISGPHELSTSQNDNAHLQCSLQTTMNKLNELEKICEILQAEKYELVTELNDSRSECITATRKMAEEVGKLLNEVKILNDDSGLLHGELVEDIPGGEFGEQPNEQHPVSLAPLDESNSYEHLTLSDKEVQMHFAELQEKFLSLQSEHKILHDQHCQMSSKMSELQTYVDSLKAENLVLSTNLRNFQGDLVKEMQLGLEEGLVPSLSSSCVPDSSSLSSLGDSSFYRALLEQTGDMSLLSNLEGAVSANQCSVDEVFCSSLQTYVDSLKAENLVLSTNLRNFQGDLVKEMQLGLEEGLVPSLSSSCVPDSSSLSSLGDSSFYRALLEQTGDMSLLSNLEGVVSANQCSVDEVFCSSLQEENLTRKETPSAPAKGVEELESLCEVYRQSLEKLEEKMESQGIMKNKEIQELEQLLSSERQELDCLRKQYLSENEQWQQKLTSVTLEMESKLAAEKKQTEQLSLELEVARLQLQGLDLSSRSLLGIDTEDAIQGRNESCDISKEHTSETTERTPKHDVHQICDKDAQQDLNLDIEKITETGAVKPTGECSGEQSPDTNYEPPGEDKTQGSSECISELSFSGPNALVPMDFLGNQEDIHNLQLRVKETSNENLRLLHVIEDRDRKVESLLNEMKELDSKLHLQEVQLMTKIEACIELEKIVGELKKENSDLSEKLEYFSCDHQELLQRVETSEGLNSDLEMHADKSSREDIGDNVAKVNDSWKERFLDVENELSRIRSEKASIEHEALYLEADLEVVQTEKLCLEKDNENKQKVIVCLEEELSVVTSERNQLRGELDTMSKKTTALDQLSEKMKEKTQELESHQSECLHCIQVAEAEVKEKTELLQTLSSDVSELLKDKTHLQEKLQSLEKDSQALSLTKCELENQIAQLNKEKELLVKESESLQARLSESDYEKLNVSKALEAALVEKGEFALRLSSTQEEVHQLRRGIEKLRVRIEADEKKQLHIAEKLKERERENDSLKDKVENLERELQMSEENQELVILDAENSKAEVETLKTQIEEMARSLKVFELDLVTLRSEKENLTKQIQEKQGQLSELDKLLSSFKSLLEEKEQAEIQIKEESKTAVEMLQNQLKELNEAVAALCGDQEIMKATEQSLDPPIEEEHQLRNSIEKLRARLEADEKKQLCVLQQLKESEHHADLLKGRVENLERELEIARTNQEHAALEAENSKGEVETLKAKIEGMTQSLRGLELDVVTIRSEKEDLTNELQKEQERISELEIINSSFENILQEKEQEKVQMKEKSSTAMEMLQTQLKELNERVAALHNDQEACKAKEQNLSSQVECLELEKAQLLQGLDEAKNNYIVLQSSVNGLIQEVEDGKQKLEKKDEEISRLKNQIQDQEQLVSKLSQVEGEHQLWKEQNLELRNLTVELEQKIQVLQSKNASLQDTLEVLQSSYKNLENELELTKMDKMSFVEKVNKMTAKETELQREMHEMAQKTAELQEELSGEKNRLAGELQLLLEEIKSSKDQLKELTLENSELKKSLDCMHKDQVEKEGKVREEIAEYQLRLHEAEKKHQALLLDTNKQYEVEIQTYREKLTSKEECLSSQKLEIDLLKSSKEELNNSLKATTQILEELKKTKMDNLKYVNQLKKENERAQGKMKLLIKSCKQLEEEKEILQKELSQLQAAQEKQKTGTVMDTKVDELTTEIKELKETLEEKTKEADEYLDKYCSLLISHEKLEKAKEMLETQVAHLCSQQSKQDSRGSPLLGPVVPGPSPIPSVTEKRLSSGQNKASGKRQRSSGIWENGGGPTPATPESFSKKSKKAVMSGIHPAEDTEGTEFEPEGLPEVVKKGFADIPTGKTSPYILRRTTMATRTSPRLAAQKLALSPLSLGKENLAESSKPTAGGSRSQKVKVAQRSPVDSGTILREPTTKSVPVNNLPERSPTDSPREGLRVKRGRLVPSPKAGLESKGSENCKVQ

SEQ ID NO: 1155 - protein, 152 aa, Homo sapiens [sequence omitted]

SEQ ID NO: 1156 - protein, 454 aa, Homo sapiens
  misc_feature (0)...(0): Polypeptide Accession Number P49593
MSSGAPQKSSPMASGAEETPGFLDTLLQDFPALLNPEDPLPWKAPGTVLSQEEVEGELAELAMGFLGSRKAPPPLAAALAHEAVSQLLQTDLSEFRKLPREEEEEEEDDDEEEKAPVTLLDAQSLAQSFFNRLWEVAGQWQKQVPLAARASQRQWLVSIHAIRNTRRKMEDRHVSLPSFNQLFGLSDPVNRAYFAVFDGHGGVDAARYAAVHVHTNAARQPELPTDPEGALREAFRRTDQMFLRKAKRERLQSGTTGVCALIAGATLHVAWLGDSQVILVQQGQVVKLMEPHRPERQDEKARIEALGGFVSHMDCWRVNGTLAVSRAIGDVFQKPYVSGEADAASRALTGSEDYLLLACDGFFDVVPHQEVVGLVQSHLTRQQGSGLRVAEELVAAARERGSHDNITVMVVFLRDPQELLEGGNQGEGDPQAEGRRQDLPSSLPEPETQAPPRS

SEQ ID NO: 1157 - protein, 416 aa, Homo sapiens
  misc_feature (0)...(0): Polypeptide Accession Number P49674
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFCRSLRFDDKPDYSYLRQLFRNLFHRQGFSYDYVFDWNMLKFGAARNPEDVDRERREHEREERMGQLRGSATRALPPGPPTGATANRLRSAAEPVASTPASRIQPAGNTSPRAISRVDRERKVSMRLHRGAPANVSSSDLTGRQEVSRIPASQTSVPFDHLGK

SEQ ID NO: 1158 - protein, 895 aa, Homo sapiens [sequence omitted]

SEQ ID NO: 1159 - protein, 351 aa, Homo sapiens
  misc_feature (0)...(0): Polypeptide Accession Number P49770
MPGSAAKGSELSERIESFVETLKRGGGPRSSEEMARETLGLLRQIITDHRWSNAGELMELIRREGRRMTAAQPSETTVGNMVRRVLKIIREEYGRLHGRSDESDQQESLHKLLTSGGLNEDFSFHYAQLQSNIIEAINELLVELEGTMENIAAQALEHIHSNEVIMTIGFSRTVEAFLKEAARKRKFHVIVAECAPFCQGHEMAVNLSKAGIETTVMTDAAIFAVMSRVNKVIIGTKTILANGALRAVTGTHTLALAAKHHSTPLIVCAPMFKLSPQFPNEEDSFHKFVAPEEVLPFTEGDILEKVSVHCPVFDYVPPELITLFISNIGGNAPSYIYRLMSELYHPDDHVL

SEQ ID NO: 1160 - protein, 1475 aa, Homo sapiens [sequence omitted]

SEQ ID NO: 1161 - protein, 3224 aa, Homo sapiens
  misc_feature (0)...(0): Polypeptide Accession Number P49792
MRRSKADVERYIASVQGSTPSPRQKSMKGFYFAKLYYEAKEYDLAKKYICTYINVQERDPKAHRFLGLLYELEENTDKAVECYRRSVELNPTQKDLVLKIAELLCKNDVTDGRAKYWLERAAKLFPGSPAIYKLKEQLLDCEGEDGWNKLFDLIQSELYVRPDDVHVNIRLVEVYRSTKRLKDAVAHCHEAERNIALRSSLEWNSCVVQTLKEYLESLQCLESDKSDWRATNTDLLLAYANLMLLTLSTRDVQESRELLQSFDSALQSVKSLGGNDELSATFLEMKGHFYMHAGSLLLKMGQHSSNVQWRALSELAALCYLIAFQVPRPKIKLIKGEAGQNLLEMMACDRLSQSGHMLLNLSRGKQDFLKEIVETFANKSGQSALYDALFSSQSPKDTSFLGSDDIGNIDVREPELEDLTRYDVGAIRAHNGSLQHLTWLGLQWNSLPALPGIRKWLKQLFHHLPHETSRLETNAPESICILDLEVFLLGVVYTSHLQLKEKCNSHHSSYQPLCLPLPVCKQLCTERQKSWWDAVCTLIHRKAVPGNVAKLRLLVQHEINTLRAQEKHGLQPALLVHWAECLQKTGSGLNSFYDQREYIGRSVHYWKKVLPLLKIIKKKNSIPEPIDPLFKHFHSVDIQASEIVEYEEDAHITFAILDAVNGNIEDAVTAFESIKSVVSYWNLALIFHRKAEDIENDALSPEEQEECKNYLRKTRDYLIKIIDDSDSNLSVVKKLPVPLESVKEMLNSVMQELEDYSEGGPLYKNGSLRNADSEIKRSTPSPTRYSLSPSKSYKYSPKTPPRWAEDQNSLLKMICQQVEAIKKEMQELKLNSSNSASPHRWPTENYGPDSVPDGYQGSQTFHGAPLTVATTGPSVYYSQSPAYNSQYLLRPAANVTPTKGPVYGMNRLPPQQHIYAYPQQMHTPPVQSSSACMFSQEMYGPPALRFESPATGILSPRGDDYFNYNVQQTSTNPPLPEPGYFTKPPIAAHASRSAESKTIEFGKTNFVQPMPGEGLRPSLPTQAHTTQPTPFKFNSNFKSNDGDFTFSSPQVVTQPPPAAYSNSESLLGLLTSDKPLQGDGYSGAKPIPGGQTIGPRNTFNFGSKNVSGISFTENMGSSQQKNSGFRRSDDMFTFHGPGKSVFGTPTLETANKNHETDGGSAHGDDDDDGPHFEPVVPLPDKIEVKTGEEDEEEFFCNRAKLFRFDVESKEWKERGIGNVKILRHKTSGKIRLLMRREQVLKICANHYISPDMKLTPNAGSDRSFVWHALDYADELPKPEQLAIRFKTPEEAALFKCKFEEAQSILKAPGTNVAMASNQAVRIVKEPTSHDNKDICKSDAGNLNFEFQVAKKEGSWWHCNSCSLKNASTAKKCVSCQNLNPSNKELVGPPLAETVFTPKTSPENVQDRFALVTPKKEGHWDCSICLVRNEPTVSRCIACQNTKSANKSGSSFVHQASFKFGQGDLPKPINSDFRSVFSTKEGQWDCSACLVQNEGSSTKCAACQNPRKQSLPATSIPTPASFKFGTSETSKTLKSGFEDMFAKKEGQWDCSSCLVRNEANATRCVACQNPDKPSPSTSVPAPASFKFGTSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQNPGKQNQTTSAVSTPASSETSKAPKSGFEGMFTKKEGQWDCSVCLVRNEASATKCIACQCPSKQNQTTAISTPASSEISKAPKSGFEGMFIRKGQWDCSVCCVQNESSSLKCVACDASKPTHKPIAEAPSAFTLGSEMKLHDSSGSQVGTGFKSNFSEKASKFGNTEQGFKFGHVDQENSPSFMFQGSSNTEFKSTKEGFSIPVSADGFKFGISEPGNQEKKSEKPLENGTGFQAQDISGQKNGRGVIFGQTSSTFTFADLAKSTSGEGFQFGKKDPNFKGFSGAGEKLFSSQYGKMANKANTSGDFEKDDDAYKTEDSDDIHFEPVVQMPEKVELVTGEEDEKVLYSQRVKLFRFDAEVSQWKERGLGNLKILKNEVNGKLRMLMRREQVLKVCANHWITTTMNLKPLSGSDRAWMWLASDFSDGDAKLEQLAAKFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDSVSSSSVHASPLASSPVRKNLFRFGESTTGFNFSFKSALSPSKSPAKLNQSGTSVGTDEESDVTQEEERDGQYFEPVVPLPDLVEVSSGEENEQVVFSHRAKLYRYDKDVGQWKERGIGDIKILQNYDNKQVRIVMRRDQVLKLCANHRITPDMTLQNMKGTERVWLWTACDFADGERKVEHLAVRFKLQDVADSFKKIFDEAKTAQEKDSLITPHVSRSSTPRESPCGKIAVAVLEETTRERTDVIQGDDVADATSEVEVSSTSETTPKAVVSPPKFVFGSESVKSIFSSEKSKPFAFGNSSATGSLFGFSFNAPLKSNNSETSSVAQSGSESKVEPKKCELSKNSDIEQSSDSKVKNLFASFPTEESSINYTFKTPEKAKEKKKPEDSPSDDDVLIVYELTPTAEQKALATKLKLPPTFFCYKNRPDYVSEEEEDDEDFETAVKKLNGKLYLDGSEKCRPLEENTADNEKECIIVWEKKPTVEEKAKADTLKLPPTFFCGVCSDTDEDNGNGEDFQSELQKVQEAQKSQTEEITSTTDSVYTGGTEVMVPSFCKSEEPDSITKSISSPSVSSETMDKPVDLSTRKEIDTDSTSQGESKIVSFGFGSSTGLSFADLASSNSGDFAFGSKDKNFQWANTGAAVFGTQSVGTQSAGKVGEDEDGSDEEVVHNEDIHFEPIVSLPEVEVKSGEEDEEILFKERAKLYRWDRDVSQWKERGVGDIKILWHTMKNYYRILMRRDQVFKVCANHVITKTMELKPLNVSNNALVWTASDYADGEAKVEQLAVRFKTKEVADCFKKTFEECQQNLMKLQKGHVSLAAELSKETNPVVFFDVCADGEPLGRITMELFSNIVPRTAENFRALCTGEKGFGFKNSIFHRVIPDFVCQGGDITKHDGTGGQSIYGDKFEDENFDVKHTGPGLLSMANQGQNTNNSQFVITLKKAEHLDFKHVVFGFVKDGMDTVKKIESFGSPKGSVCRRITITECGQI

SEQ ID NO: 1162 - protein, 483 aa, Homo sapiens
  misc_feature (0)...(0): Polypeptide Accession Number P49840
MSGGGPSGGGPGGSGRARTSSFAEPGGGGGGGGGGPGGSASGPGGTGGGKASVGAMGGGVGASSSGGGPGGSGGGGSGGPGAGTSFPPPGVKLGRDSGKVTTVVATLGQGPERSQEVAYTDIKVIGNGSFGVVYQARLAETRELVAIKKVLQDKRFKNRELQIMRKLDHCNIVRLRYFFYSSGEKKDELYLNLVLEYVPETVYRVARHFTKAKLTIPILYVKVYMYQLFRSLAYIHSQGVCHRDIKPQNLLVDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFKSRTPPEAIALCSSLLEYTPSSRLSPLEACAHSFFDELRCLGTQLPNNRPLPPLFNFSAGELSIQPSLNAILIPPHLRSPAGTTTLTPSSQALTETPTSSDWQSTDATPTLTNSS

SEQ ID NO: 1163 - protein, 420 aa, Homo sapiens
  misc_feature (0)...(0): Polypeptide Accession Number P49841
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQPIFPGDSGVDQLVEIIKVLGTPTREQIREMNPNYTEFKFPQIKAHPWTKVFRPRTPPEAIALCSRLLEYTPTARLTPLEACAHSFFDELRDPNVKHPNGRDTPALFNFTTQELSSNPPLATILIPPHARIQAAASTPTNATAASDANTGDRGQTNNAASASASNST

SEQ ID NO: 1164 - protein, 677 aa, Homo sapiens
  misc_feature (0)...(0): Polypeptide Accession Number P49848
MAEEKKLKLSNTVLPSESMKVVAESMGIAQIQEETCQLLTDEVSYRIKEIAQDALKFMHMGKRQKLTTSDIDYALKLKNVEPLYGFHAQEFIPFRFASGGGRELYFYEEKEVDLSDIINTPLPRVPLDVCLKAHWLSIEGCQPAIPENPPPAPKEQQKAEATEPLKSAKPGQEEDGPLKGKGQGATTADGKGKEKKAPPLLEGAPLRLKPRSIHELSVEQQLYYKEITEACVGSCEAKRAEALQSIATDPGLYQMLPRFSTFISEGVRVNVVQNNLALLIYLMRMVKALMDNPTLYLEKYVHELIPAVMTCIVSRQLCLRPDVDNHWALRDFAARLVAQICKHFSTTTNNIQSRITKTFTKSWVDEKTPWTTRYGSIAGLAELGHDVIKTLILPRLQQEGERIRSVLDGPVLSNIDRIGADHVQSLLLKHCAPVLAKLRPPPDNQDAYRAEFGSLGPLLCSQVVKARAQAALQAQQVNRTTLTITQPRPTLTLSQAPQPGPRTPGLLKVPGSIALPVQTLVSARAAAPPQPSPPPTKFIVMSSSSSAPSTQQVLSLSTSAPGSGSTTTSPVTTTVPSVQPIVKLVSTATTAPPSTAPSGPGSVQKYIVVSLPPTGEGKGGPTSHPSPVPPPASSPSPLSGSALCGGKQEAGDSPPPAPGTPKANGSQPNSGSPQPAP

SEQ ID NO: 1165 - protein, 680 aa, Homo sapiens [sequence omitted]

SEQ ID NO: 1166 - protein, 369 aa, Homo sapiens
  misc_feature (0)...(0): Polypeptide Accession Number P50502
MDPRKVNELRAFVKMCKQDPSVLHTEEMRFLREWVESMGGKVPPATQKAKSEENTKEEKPDSKKVEEDLKADEPSSEESDLEIDKEGVIEPDTDAPQEMGDENAEITEEMMDQANDKKVAAIEALNDGELQKAIDLFTDAIKLNPRLAILYAKRASVFVKLQKPNAAIRDCDRAIEINPDSAQPYKWRGKAHRLLGHWEEAAHDLALACKLDYDEDASAMLKEVQPRAQKIAEHRRKYERKREEREIKERIERVKKAREEHERAQREEEARRQSGAQYGSFPGGFPGGMPGNFPGGMPGMGGGMPGMAGMPGLNEILSDPEVLAAMQDPEVMVAFQDVAQNPANMSKYQSNPKVMNLISKLSAKFGGQA

SEQ ID NO: 1167 - protein, 158 aa, Homo sapiens [sequence omitted]

SEQ ID NO: 1168 - protein, 870 aa, Homo sapiens
  misc_feature (0)...(0): Polypeptide Accession Number P50570
MGNRGMEELIPLVNKLQDAFSSIGQSCHLDLPQIAVVGGQSAGKSSVLENFVGRDFLPRGSGIVTRRPLILQLIFSKTEHAEFLHCKSKKFTDFDEVRQEIEAETDRVTGTNKGISPVPINLRVYSPHVLNLTLIDLPGITKVPVGDQPPDIEYRVKDMILQFISRESSLILAVTPANMDLANSDALKLAKEVDPQGLRTIGVITKLDLMDEGTDARDVLENKLLPLRRGYIGVVNRSQKDIEGKKDIRAALAAERKFFLSHPAYRHMADRMGTPHLQKTLNQQLTNHIRESLPALRSKLQSQLLSLEKEVEEYKIFRPDDPTPKTKALLQMVQQFGVDFEKRIEGSGDQVDTLELSGGARINRIFHERFPFELVKMEFDEKDLRREISYAIKNIHGVRTGLFTPDLAFEAIVKKQVVKLKEPCLKCVDLVIQELINTVRQCTSKLSSYPRLREETERIVTTYIREREGRTKDQILLLIDIEQSYINTNHEDFIGFANAQQRSTQLNKKRAIPNQGEILVIRRGWLTINNISLMKGGSKEYWFVLTAESLSWYKDEEEKEKKYMLPLDNLKIRDVEKGFMSNKHVFAIFNTEQRNVYKDLRQIELACDSQEDVDSWKASFLRAGVYPEKDQAENEDGAQENTFSMDPQLERQVETIRNLVDSYVAIINKSIRDLMPKTIMHLMINNTKAFIHHELLAYLYSSADQSSLMEESADQAQRRDDMLRMYHALKEALNIIGDISTSTVSTPVPPPVDDTWLQSASSHSPTPQRRPVSSIHPPGRPPAVRGPTPGPPLIPVPVGAAASFSAPPIPSRPGPQSVFANSDLFPAPPQIPSRPVRIPPGIPPGVPSRRPPAAPSRPTIIRPAEPSLLD

SEQ ID NO: 1169 - protein, 346 aa, Homo sapiens
  misc_feature (0)...(0): Polypeptide Accession Number P50613
MALDVKSRAKRYEKLDFLGEGQFATVYKARDKNTNQIVAIKKIKLGHRSEAKDGINRTALREIKLLQELSHPNIIGLLDAFGHKSNISLVFDFMETDLEVIIKDNSLVLTPSHIKAYMLMTLQGLEYLHQHWILHRDLKPNNLLLDENGVLKLADFGLAKSFGSPNRAYTHQVVTRWYRAPELLFGARMYGVGVDMWAVGCILAELLLRVPFLPGDSDLDQLTRIFETLGTPTEEQWPDMCSLPDYVTFKSFPGIPLHHIFSAAGDDLLDLIQGLFLFNPCARITATQALKMKYFSNRPGPTPGCQLPRPNCPVETLKEQSNPALAIKRKRTEALEQGGLPKKLIF

SEQ ID NO: 1170 - protein, 504 aa, Homo sapiens
  misc_feature (0)...(0): Polypeptide Accession Number P51451
GLVSSKKPDKEKPIKEKDKGQWSPLKVSAQDKDAPPLPPLVVFNHLTPPPPDEHLDEDKHFVVALYDYTAMNDRDLQMLKGEKLQVLKGTGDWWLARSLVTGREGYVPSNFVARVESLEMERWFFRSQGRKEAERQLLAPINKAGSFLIRESETNKGAFSLSVKDVTTQGELIKHYKIRCLDEGGYYISPRITFPSLQALVQHYSKKGDGLCQRLTLPCVRPAPQNPWAQDEWEIPRQSLRLVRKLGSGQFGEVWMGYYKNNMKVAIKTLKEGTMSPEAFLGEANMMKALQHERLVRLYAVVTKEPIYIVTEYMARGCLLDFLKTDEGSRLSLPRLIDMSAQIAEGMAYIERMNSIHRDLRAANILVSEALCCKIADFGLARIIDSEYTAQEGAKFPIKWTAPEAIHFGVFTIKADVWSFGVLLMEVVTYGRVPYPGMSNPEVIRNLERGYRMPRPDTCPPELYRGVIAECWRSRPEERPTFEFLQSVLEDFYTATERQYELQP

SEQ ID NO: 1171 - protein, 1586 aa, Homo sapiens
  misc_feature (0)...(0): Polypeptide Accession Number P51531
MSTPTDPGAMPHPGPSPGPGPSPGPILGPSPGPGPSPGSVHSMMGPSPGPPSVSHPMPTMGSTDFPQEGMHQMHKPIDGIHDKGIVEDIHCGSMKGTGMRPPHPGMGPPQSPMDQHSQGYMSPHPSPLGAPEHVSSPMSGGGPTPPQMPPSQPGALIPGDPQAMSQPNRGPSPFSPVQLHQLRAQILAYKMLARGQPLPETLQLAVQGKRTLPGLQQQQQQQQQQQQQQQQQQQQQQQPPQPQTQQQQQPALVNYNRPSGPGPELSGPSTPQKLPVPAPGGRPSPAPPAAAQPPAAAVPGPSVPQPAPGQPSPVLQLQQKQSRISPIQKPQGLDPVEILQEREYRLQARIAHRIQELENLPGSLPPDLRTKATVELKALRLLNFQRQLRQEVVACMRRDTTLETALNSKAYKRSKRQTLREARMTEKLEKQQKIEQERKRRQKHQEYLNSILQHAKDFKEYHRSVAGKIQKLSKAVATWHANTEREQKKETERIEKERMRRLMAEDEEGYRKLIDQKKDRRLAYLLQQTDEYVANLTNLVWEHKQAQAAKEKKKRRRRKKKAEENAEGGESALGPDGEPIDESSQMSDLPVKVTHTETGKVLFGPEAPKASQLDAWLEMNPGYEVAPRSDSEESDSDYEEEDEEEESSRQETEEKILLDPNSEEVSEKDAKQIIETAKQDVDDEYSMQYSARGSQSYYTVAHAISEWVEKQSALLINGTLKHYQLQGLEWMVSLYNNNLNGILADEMGLGKTIQTIALITYLMEHKRLNGPYLIIVPLSTLSNWTYEFDKWAPSVVKISYKGTPAMRRSLVPQLRSGKFNVLLTTYEYIIKDKHILAKIRWKYMIVDEGHRMKNHHCKLTQVLNTHYVAPRRILLTGTPLQNKLPELWALLNFLLPTIFKSCSTFEQWFNAPFAMTGERVDLNEEETILIIRRLHKVLRPFLLRRLKKEVESQLPEKVEYVIKCDMSALQKILYRHMQAKGILLTDGSEKDKKGKGGAKTLMNTIMQLRKICNHPYMFQHIEESFAEHLGYSNGVINGAELYRASGKFELLDRILPKLRATNHRVLLFCQMTSLMTIMEDYFAFRNFLYLRLDGTTKSEDRAALLKKFNEPGSQYFIFLLSTRAGGLGLNLQAADTVVIFDSDWNPHQDLQAQDRAHRIGQQNEVRVLRLCTVNSVEEKILAAAKYKLNVDQKVIQAGMFDQKSSSHERRAFLQAILEHEEENEEEDEVPDDETLNQMIARREEEFDLFMRMDMDRRREDARNPKRKPRLMEEDELPSWIIKDDAEVERLTCEEEEEKIFGRGSRQRRDVDYSDALTEKQWLRAIEDGNLEEMEEEVRLKKRKRRRNVDKDPAKEDVEKAKKRRGRPPAEKLSPNPPKLTKQMNAIIDTCINYKDSCNVEKVPSNSQLEIEGNSSGRQLSEVFIQLPSRKELPEYYELIRKPVDFKKIKERIRNHKYRSLGDLEKDVMLLCHNAQTFNLEGSQIYEDSIVLQSVFKSARQKIAKEEESEDESNEEEEEEDEEESESEAKSVKVKIKLNKKDDKGRDKGKGKKRPNRGKAKPVVSDFDSDEEQDEREQSEGSGTDDE

SEQ ID NO: 1172 - protein, 1647 aa, Homo sapiens
  misc_feature (0)...(0): Polypeptide Accession Number P51532
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVPQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 1173 - protein, 535 aa, Homo sapiens
  misc_feature (0)...(0): Polypeptide Accession Number P51649
MATCIWLRSCGARRLGSTFPGCRLRPRAGGLVPASGPAPGPAQLRCYAGRLAGLSAALLRTDSFVGGRWLPAAATFPVQDPASGAALGMVADCGVREARAAVRAAYEAFCRWREVSAKERSSLLRKWYNLMIQNKDDLARIITAESGKPLKEAHGEILYSAFFLEWFSEEARRVYGDIIHTPAKDRRALVLKQPIGVAAVITPWNFPSAMITRKVGAALAAGCTVVVKPAEDTPFSALALAELASQAGIPSGVYNVIPCSRKNAKEVGEAICTDPLVSKISFTGSTTTGKILLHHAANSVKRVSMELGGLAPFIVFDSANVDQAVAGAMASKFRNTGQTCVCSNQFLVQRGIHDAFVKAFAEAMKKNLRVGNGFEEGTTQGPLINEKAVEKVEKQVNDAVSKGATVVTGGKRHQLGKNFFEPTLLCNVTQDMLCTHEETFGPLAPVIKFDTEEEAIAIANAADVGLAGYFYSQDPAQIWRVAEQLEVGMVGVNEGLISSVECPFGGVKQSGLGREGSKYGIDEYLELKYVCYGGL

SEQ ID NO: 1174 - protein, 147 aa, Homo sapiens
  misc_feature (0)...(0): Polypeptide Accession Number P51668
MALKRIQKELSDLQRDPPAHCSAGPVGDDLFHWQATIMGPPDSAYQGGVFFLTVHFPTDYPFKPPKIAFTTKIYHPNINSNGSICLDILRSQWSPALTVSKVLLSICSLLCDPNPDDPLVPDIAQIYKSDKEKYNRHAREWTQKYAM

SEQ ID NO: 1175 - protein, 147 aa, Homo sapiens
  misc_feature (0)...(0): Polypeptide Accession Number P51669
MALKRIHKELNDLARDPPAQCSAGPVGDDMFHWQATIMGPNDSPYQGGVFFLTIHFPTDYPFKPPKVAFTTRIYHPNINSNGSICLDILRSQWSPALTISKVLLSICSLLCDPNPDDPLVPEIARIYKTDREKYNRIAREWTQKYAM

SEQ ID NO: 1176 - protein, 690 aa, Homo sapiens
  misc_feature (0)...(0): Polypeptide Accession Number P51784
METRKKDGTWPSAQLHVMNNNMSEEDEDFKGQPGICGLTNLGNTCFMNSALQCLSNVPQLTEYFLNNCYLEELNFRNPLGMKGEIAEAYADLVKQAWSGHHRSIVPHVFKNKVGHFASQFLGYQQHDSQELLSFLLDGLHEDLNRVKKKEYVELCDAAGRPDQEVAQEAWQNHKRRNDSVIVDTFHGLFKSTLVCPDCGNVSVTFDPFCYLSVPLPISHKRVLEVFFIPMDPRRKPEQHRLVVPKKGKISDLCVALSKHTGISPERMMVADVFSHRFYKLYQLEEPLSSILDRDDIFVYEVSGRIEAIEGSREDIVVPVYLRERTPARDYNNSYYGLMLFGHPLLVSVPRDRFTWEGLYNVLMYRLSRYVTKPNSDDEDDGDEKEDDEEDKDDVPGPSTGGSLRDPEPEQAGPSSGVTNRCPFLLDNCLGTSQWPPRRRRKQLFTLQTVNSNGTSDRTTSPEEVHAQPYIAIDWEPEMKKRYYDEVEAEGYVKHDCVGYVMKKAPVRLQECIELFTTVETLEKENPWYCPSCKQHQLATKKLDLWMLPEILIIHLKRFSYTKFSREKLDTLVEFPIRDLDFSEFVIQPQNESNPELYKYDLIAVSNHYGGMRDGHYTTFACNKDSGQWHYFDDNSVSPVNENQIESKAAYVLFYQRQDVARRLLSPAGSSGAPASPACSSPPSSEFMDVN

SEQ ID NO: 1177 - protein, 506 aa, Homo sapiens
  misc_feature (0)...(0): Polypeptide Accession Number P51786
MPANGTSPQRFPALIPGEPGRSFEGSVSFEDVAVDFTRQEWHRLDPAQRTMHKDVMLETYSNLASVGLCVAKPEMIFKLERGEELWILEEESSGHGYSGSLSLLCGNGSVGDNALRHDNDLLHHQKIQTLDQNVEYNGCRKAFHEKTGFVRRKRTPRGDKNFECNECGKAYCRKSNLVEHLRIHTGERPYECGECAKTFSARSYLIAHQKTHTGERPFECNECGKSFGRKSQLILHTRTHTGERPYECTECGKTFSEKATLTIHQRTHTGEKPYECSECGKTFRVKISLTQHHRTHTGEKPYECGECGKNFRAKKSLNQHQRIHTGEKPYECGECGKFFRMKMTLNNHQRTHTGEKPYQCNECGKSFRVHSSLGIHQRIHTGEKPYECNECGNAFYVKARLIEHQRMHSGEKPYECSECGKIFSMKKSLCQHRRTHTGEKPYECSECGNAFYVKVRLIEHQRIHTGERPFECQECGKAFCRKAHLTEHQRTHIGWSWRCTMKKASH

SEQ ID NO: 1178 - protein, 740 aa, Homo sapiens
  misc_feature (0)...(0): Polypeptide Accession Number P51812
MPLAQLADPWQKMAVESPSDSAENGQQIMDEPMGEEEINPQTEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFGVLMFEMLTGTLPFQGKDRKETMTMILKAKLGMPQFLSPEAQSLLRMLFKRNPANRLGAGPDGVEEIKRHSFFSTIDWNKLYRREIHPPFKPATGRPEDTFYFDPEFTAKTPKDSPGIPPSANAHQLFRGFSFVAITSDDESQAMQTVGVHSIVQQLHRNSIQFTDGYEVKEDIGVGSYSVCKRCIHKATNMEFAVKIIDKSKRDPTEEIEILLRYGQHPNIITLKDVYDDGKYVYVVTELMKGGELLDKILRQKFFSEREASAVLFTITKTVEYLHAQGVVHRDLKPSNILYVDESGNPESIRICDFGFAKQLRAENGLLMTPCYTANFVAPEVLKRQGYDAACDIWSLGVLLYTMLTGYTPFANGPDDTPEEILARIGSGKFSLSGGYWNSVSDTAKDLVSKMLHVDPHQRLTAALVLRHPWIVHWDQLPQYQLNRQDAPHLVKGAMAATYSALNRNQSPVLEPVGRSTLAQRRGIKKITSTAL

SEQ ID NO: 1179 - protein, 1210 aa, Homo sapiens
  misc_feature (0)...(0): Polypeptide Accession Number P51825
MAAQSSLYNDDRNLLRIREKERRNQEAHQEKEAFPEKIPLFGEPYKTAKGDELSSRIQNMLGNYEEVKEFLSTKSHTHRLDASENRLGKPKYPLIPDKGSSIPSSSFHTSVHHQSIHTPASGPLSVGNISHNPKMAQPRTEPMPSLHAKSCGPPDSQHLTQDRLGQEGFGSSHHKKGDRRADGDHCASVTDSAPERELSPLISLPSPVPPLSPIHSNQQTLPRTQGSSKVHGSSNNSKGYCPAKSPKDLAVKVHDKETPQDSLVAPAQPPSQTFPPPSLPSKSVAMQQKPTAYVRPMDGQDQAPSESPELKPLPEDYRQQTFEKTDLKVPAKAKLTKLKMPSQSVEQTYSNEVHCVEEILKEMTHSWPPPLTAIHTPSTAEPSKFPFPTKDSQHVSSVTQNQKQYDTSSKTHSNSQQGTSSMLEDDLQLSDSEDSDSEQTPEKPPSSSAPPSAPQSLPEPVASAHSSSAESESTSDSDSSSDSESESSSSDSEENEPLETPAPEPEPPTTNKWQLDNWLTKVSQPAAPPEGPRSTEPPRRHPESKGSSDSATSQEHSESKDPPPKSSSKAPRAPPEAPHPGKRSCQKSPAQQEPPQRQTVGTKQPKKPVKASARAGSRTSLQGEREPGLLPYGSRDQTSKDKPKVKTKGRPRAAASNEPKPAVPPSSEKKKHKSSLPAPSKALSGPEPAKDNVEDRTPEHFALVPLTESQGPPHSGSGSRTSGCRQAVVVQEDSRKDRLPLPLRDTKLLSPLRDTPPPQSLMVKITLDLLSRIPQPPGKGSRQRKAEDKQPPAGKKHSSEKRSSDSSSKLAKKRKGEAERDCDNKKIRLEKEIKSQSSSSSSSHKESSKTKPSRPSSQSSKKEMLPPPPVSSSSQKPAKPALKRSRREADTCGQDPPKSASSTKSNHKDSSIPKQRRVEGKGSRSSSEHKGSSGDTANPFPVPSLPNGNSKPGKPQVKFDKQQADLHMREAKKMKQKAELMTDRVGKAFKYLEAVLSFIECGIATESESQSSKSAYSVYSETVDLIKFIMSLKSFSDATAPTQEKIFAVLCMRCQSILNMAMFRCKKDIAIKYSRTLNKHFESSSKVAQAPSPCIASTGTPSPLSPMPSPASSVGSQSSAGSVGSSGVAATISTPVTIQNMTSSYVTITSHVLTAFDLWEQAEALTRKNKEFFARLSTNVCTLALNSSLVDLVHYTRQGFQQLQELTKTP

SEQ ID NO: 1180 - protein, 557 aa, Homo sapiens
  misc_feature (0)...(0): Polypeptide Accession Number P51854
MSVLFFYIMRYKQSDPENPDNDRFVLAKRLSFVDVATGWLGQGLGVACGMAYTGKYFDRASYRVFCLMSDGESSEGSVWEAMAFASYYSLDNLVAIFDVNRLGHSGALPAEHCINIYQRRCEAFGWNTYVVDGRDVEALCQVFWQASQVKHKPTAVVAKTFKGRGTPSIEDAESWHAKPMPRERADAIIKLIESQIQTSRNLDPQPPIEDSPEVNITDVRMTSPPDYRVGDKIATRKACGLALAKLGYANNRVVVLDGDTRYSTFSEIFNKEYPERFIECFMAEQNMVSVALGCASRGRTIAFASTFAAFLTRAFDHIRIGGLAESNINIIGSHCGVSVGDDGASQMALEDIAMFRTIPKCTIFYPTDAVSTEHAVALAANAKGMCFIRTTRPETMVIYTPQERFEIGQAKGVSMLQDSWSSVISYQKVLRHCVSDKVTVIGAGITVYEALAAADELSKQDIFIRVIDLFTIKPLDVATIVSSAKATEGRIITVEDHYPQGGIGEAVCAAVSMDPDIQVHSLAVSGVPQSGKSEELLDMYGISARHIIVAVKCMLLN

SEQ ID NO: 1181 - protein, 445 aa, Homo sapiens
  misc_feature (0)...(0): Polypeptide Accession Number P51955
MPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPELLNLPSSVIKKKVHFSGESKENIMRSENSESQLTSKSKCKDLKKRLHAAQLRAQALSDIEKNYQLKSRQILGMR

SEQ ID NO: 1182 - protein, 459 aa, Homo sapiens
  misc_feature (0)...(0): Polypeptide Accession Number P51956
RKEAVLSAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKTNPSRIRIALGNEASTVQEEEQDRKGSHTDLESINENLVESALRRVNREEKGNKSVHLRKASSPNLHRRQWEKNVPNTALTALENASILTSSLTAEDDRGGSVIKYSKNTTRKQWLKETPDTLLNILKNADLSLAFQTYTIYRPGSEGFLKGPLSEETEASDSVDGGHDSVILDPERLEPGLDEEDTDFEEEDDNPDWVSELKKRAGWQGLCDR

SEQ ID NO: 1183 - protein, 841 aa, Homo sapiens
  misc_feature (0)...(0): Polypeptide Accession Number P51957
MPLAAYCYLRVVGKGSYGEVTLVKHRRDGKQYVIKKLNLRNASSRERRAAEQEAQLLSQLKHPNIVTYKESWEGGDGLLYIVMGFCEGGDLYRKLKEQKGQLLPENQVVEWFVQIAMALQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPAMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQSLALSPKLECSGTILAHSNLRLLGSSDSPASASRVAGITGVCHHAQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQERKQIHCLSEDELSSSTSSTDKSDGDYGEGKGQTNEINALVQLMTQTLKLDSKESCEDVPVANPVSEFKLHRKYRDTLILHGKVAEEAEEIHFKELPSAIMPGSEKIRRLVEVLRTDVIRGLGVQLLEQVYDLLEEEDEFDREVRLREHMGEKYTTYSVKARQLKFFEENMNF

SEQ ID NO: 1184 - protein, 193 aa, Homo sapiens
  misc_feature (0)...(0): Polypeptide Accession Number P51965
MSDDDSRASTSSSSSSSSNQQTEKETNTPKKKESKVSMSKNSKLLSTSAKRIQKELADITLDPPPNCSAGPKGDNIYEWRSTILGPPGSVYEGGVFFLDITFTPEYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 1185 - protein, 529 aa, Homo sapiens [sequence omitted]

SEQ ID NO: 1186 - protein, 538 aa, Homo sapiens
  misc_feature (0)...(0): Polypeptide Accession Number P52294
MTTPGKENFRLKSYKNKSLNPDEMRRRREEEGLQLRKQKREEQLFKRRNVATAEEETEEEVMSDGGFHEAQISNMEMAPGGVITSDMIEMIFSKSPEQQLSATQKFRKLLSKEPNPPIDEVISTPGVVARFVEFLKRKENCSLQFESAWVLTNIASGNSLQTRIVIQARAVPIFIELLSSEFEDVQEQAVWALGNIAGDSTMCRDYVLDCNILPPLLQLFSKQNRLTMTRNAVWALSNLCRGKSPPPEFAKVSPCLNVLSWLLFVSDTDVLADACWALSYLSDGPNDKIQAVIDAGVCRRLVELLMHNDYKVVSPALRAVGNIVTGDDIQTQVILNCSALQSLLHLLSSPKESIKKEACWTISNITAGNRAQIQTVIDANIFPALISILQTAEFRTRKEAAWAITNATSGGSAEQIKYLVELGCIKPLCDLLTVMDSKIVQVALNGLENILRLGEQEAKRNGTGINPYCALIEEAYGLDKIEFLQSHENQEIYQKAFDLIEHYFGTEDEDSSIAPQVDLNQQQYIFQQCEAPMEGFQL

SEQ ID NO: 1187 - protein, 334 aa, Homo sapiens
  misc_feature (0)...(0): Polypeptide Accession Number P52564
MSQSKGKKRNPGLKIPKEAFEQPQTSSTPPRDLDSKACISIGNQNFEVKADDLEPIMELGRGAYGVVEKMRHVPSGQIMAVKRIRATVNSQEQKRLLMDLDISMRTVDCPFTVTFYGALFREGDVWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQKGYSVKSDIWSLGITMIELAILRFPYDSWGTPFQQLKQVVEEPSPQLPADKFSAEFVDFTSQCLKKNSKERPTYPELMQHPFFTLHESKGTDVASFVKLILGD

SEQ ID NO: 1188 - protein, 204 aa, Homo sapiens
  misc_feature (0)...(0): Polypeptide Accession Number P52565
MAEQEPTAEQLAQIAAENEEDEHSVNYKPPAQKSIQEIQELDKDDESLRKYKEALLGRVAVSADPNVPNVVVTGLTLVCSSAPGPLELDLTGDLESFKKQSFVLKEGVEYRIKISFRVNREIVSGMKYIQHTYRKGVKIDKTDYMVGSYGPRAEEYEFLTPVEEAPKGMLARGSYSIKSRFTDDDKTDHLSWEWNLTIKKDWKD

SEQ ID NO: 1189 - protein, 201 aa, Homo sapiens
  misc_feature (0)...(0): Polypeptide Accession Number P52566
MTEKAPEPHVEEDDDDELDSKLNYKPPPQKSLKELQEMDKDDESLIKYKKTLLGDGPVVTDPKAPNVVVTRLTLVCESAPGPITMDLTGDLEALKKETIVLKEGSEYRVKIHFKVNRDIVSGLKYVQHTYRTGVKVDKATFMVGSYGPRPEEYEFLTPVEEAPKGMLARGTYHNKSFFTDDDKQDHLSWEWNLSIKKEWTE

SEQ ID NO: 1190 - protein, 658 aa, Homo sapiens [sequence omitted]

SEQ ID NO: 1191 - protein, 376 aa, Homo sapiens
  misc_feature (0)...(0): Polypeptide Accession Number P52655
MANSANTNTVPKLYRSVIEDVINDVRDIFLDDGVDEQVLMELKTLWENKLMQSRAVDGFHSEEQQLLLQVQQQHQPQQQQHHHHHHHQQAQPQQTVPQQAQTQQVLIPASQQATAPQVIVPDSKLIQHMNASNMSAAATAATLALPAGVTPVQQILTNSGQLLQVVRAANGAQYIFQPQQSVVLQQQVIPQMQPGGVQAPVIQQVLAPLPGGISPQTGVIIQPQQILFTGNKTQVIPTTVAAPTPAQAQITATGQQQPQAQPAQTQAPLVLQVDGTGDTSSEEDEDEEEDYDDDEEEDKEKDGAEDGQVEEEPLNSEDDVSDEEGQELFDTENVVVCQYDKIHRSKNKWKFHLKDGIMNLNGRDYIFSKAIGDAEW

SEQ ID NO: 1192 - protein, 1360 aa, Homo sapiens [sequence omitted]

SEQ ID NO: 1193 - protein, 654 aa, Homo sapiens
  misc_feature (0)...(0): Polypeptide Accession Number P52736
MAFRDVAVDFTQDEWRLLSPAQRTLYREVMLENYSNLVSLGISFSKPELITQLEQGKETWREEKKCSPATCPADPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQTGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 1194 - protein, 589 aa, Homo sapiens
  misc_feature (0)...(0): Polypeptide Accession Number P52740
MCGPFLKDILHLAEHQGTQSEEKPYTCGACGRDFWLNANLHQHQKEHSGGKPFRWYKDRDALMKSSKVHLSENPFTCREGGKVILGSCDLLQLQAVDSGQKPYSNLGQLPEVCTTQKLFECSNCGKAFLKSSTLPNHLRTHSEEIPFTCPTGGNFLEEKSILGNKKFHTGEIPHVCKECGKAFSHSSKLRKHQKFHTEVKYYECIACGKTFNHKLTFVHHQRIHSGERPYECDECGKAFSNRSHLIRHEKVHTGERPFECLKCGRAFSQSSNFLRHQKVHTQVRPYECSQCGKSFSRSSALIQHWRVHTGERPYECSECGRAFNNNSNLAQHQKVHTGERPFECSECGRDFSQSSHLLRHQKVHTGERPFECCDCGKAFSNSSTLIQHQKVHTGQRPYECSECRKSFSRSSSLIQHWRIHTGEKPYECSECGKAFAHSSTLIEHWRVHTKERPYECNECGKFFSQNSILIKHQKVHTGEKPYKCSECGKFFSRKSSLICHWRVHTGERPYECSECGRAFSSNSHLVRHQRVHTQERPYECIQCGKAFSERSTLVRHQKVHTRERTYECSQCGKLFSHLCNLAQHKKIHT

SEQ ID NO: 1195 - protein, 469 aa, Homo sapiens
  misc_feature (0)...(0): Polypeptide Accession Number P52742
MGNTWKKGEARPKCFTENCVKEKPYKCQECGKAFSHSSALIEHHRTHTGERPYECHECLKGFRNSSALTKHQRIHTGEKPYKCTQCGRTFNQIAPLIQHQRTHTGEKPYECSECGKSFSFRSSFSQHERTHTGEKPYECSECGKAFRQSIHLTQHLRIHTGEKPYQCGECGKAFSHSSSLTKHQRIHTGEKPYECHECGKAFTQITPLIQHQRTHTGEKPYECGECGKAFSQSTLLTEHRRIHTGEKPYGCNECGKTFSHSSSLSQHERTHTGEKPYECSQCGKAFRQSTHLTQHQRIHTGEKPYECNDCGKAFSHSSSLTKHQRIHTGEKPYECNQCGRAFSQLAPLIQHQRIHTGEKPYECNQCGRASARATLLIEHQRIHTKEKPYGCNECGKSFSHSSSLSQHERTHTGEKPYECHDCGKSFRQSTHLTQHRRIHTGEKPYACRDCGKAFTHSSSLTKHQRTHTG

SEQ ID NO: 1196 - protein, 815 aa, Homo sapiens
  misc_feature (0)...(0): Polypeptide Accession Number P52756
MGSDKRVSRTERSGRYGSIIDRDDRDERESRSRRRDSDYKRSSDDRRGDRYDDYRDYDSPERERERRNSDRSEDGYHSDGDYGEHDYRHDISDERESKTIMLRGLPITITESDIREMMESFEGPQPADVRLMKRKTGVSRGFAFVEFYHLQDATSWMEANQKKLVIQGKHIAMHYSNPRPKFEDWLCNKCCLNNFRKRLKCFRCGADKFDSEQEVPPGTTESVQSVDYYCDTIILRNIAPHTVVDSIMTALSPYASLAVNNIRLIKDKQTQQNRGFAFVQLSSAMDASQLLQILQSLHPPLKIDGKTIGVDFAKSARKDLVLSDGNRVSAFSVASTAIAAAQWSSTQSQSGEGGSVDYSYLQPGQDGYAQYAQYSQDYQQFYQQQAGGLESDASSASGTAVTTTSAAVVSQSPQLYNQTSNPPGSPTEEAQPSTSTSTQAPAASPTGVVPGTKYAVPDTSTYQYDESSGYYYDPTTGLYYDPNSQYYYNSLTQQYLYWDGEKETYVPAAESSSHQQSGLPPAKEGKEKKEKPKSKTAQQIAKDMERWAKSLNKQKENFKNSFQPVNSLREEERRESAAADAGFALFEKKGALAERQQLIPELVRNGDEENPLKRGLVAAYSGDSDNEEELVERLESEEEKLADWKKMACLLCRRQFPNKDALVRHQQLSDLHKQNMDIYRRSRLSEQELEALELREREMKYRDRAAERREKYGIPEPPEPKRKKQFDAGTVNYEQPTKDGIDHSNIGNKMLQAMGWREGSGLGRKCQGITAPIEAQVRLKGAGLGAKGSAYGLSGADSYKDAVRKAMFARFTEME

SEQ ID NO: 1197 - protein, 920 aa, Homo sapiens
  misc_feature (0)...(0): Polypeptide Accession Number P52948
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQVEKKGQ

SEQ ID NO: 1198 - protein, 1431 aa, Homo sapiens
  misc_feature (0)...(0): Polypeptide Accession Number P53355
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQVTCAASAQIPISRTKEEETPLHCAAWHGYYSVAKALCEAGCNVNIKNREGETPLLTASARGYHDIVECLAEHGADLNACDKDGHIALHLAVRRCQMEVIKTLLSQGCFVDYQDRHGNTPLHVACKDGNMPIVVALCEANCNLDISNKYGRTPLHLAANNGILDVVRYLCLMGASVEALTTDGKTAEDLARSEQHEHVAGLLARLRKDTHRGLFIQQLRPTQNLQPRIKLKLFGHSGSGKTTLVESLKCGLLRSFFRRRRPRLSSTNSSRFPPSPLASKPTVSVSINNLYPGCENVSVRSRSMMFEPGLTKGMLEVFVAPTHHPHCSADDQSTKAIDIQNAYLNGVGDFSVWEFSGNPVYFCCYDYFAANDPTSIHVVVFSLEEPYEIQLNPVIFWLSFLKSLVPVEEPIAFGGKLKNPLQVVLVATHADIMNVPRPAGGEFGYDKDTSLLKEIRNRFGNDLHISNKLFVLDAGASGSKDMKVLRNHLQEIRSQIVSVCPPMTHLCEKIISTLPSWRKLNGPNQLMSLQQFVYDVQDQLNPLASEEDLRRIAQQLHSTGEINIMQSETVQDVLLLDPRWLCTNVLGKLLSVETPRALHHYRGRYTVEDIQRLVPDSDVEELLQILDAMDICARDLSSGTMVDVPALIKTDNLHRSWADEEDEVMVYGGVRIVPVEHLTPFPCGIFHKVQVNLCRWIHQQSTEGDADIRLWVNGCKLANRGAELLVLLVNHGQGIEVQVRGLETEKIKCCLLLDSVCSTIENVMATTLPGLLTVKHYLSPQQLREHHEPVMIYQPRDFFRAQTLKETSLTNTMGGYKESFSSIMCFGCHDVYSQASLGMDIHASDLNLLTRRKLSRLLDPPDPLGKDWCLLAMNLGLPDLVAKYNTNNGAPKDFLPSPLHALLREWTTYPESTVGTLMSKLRELGRRDAADLLLKASSVFKINLDGNGQEAYASSCNSGTSYNSISSVVSR

SEQ ID NO: 1199 - protein, 377 aa, Homo sapiens
  misc_feature (0)...(0): Polypeptide Accession Number P53609
MVATEDERLAGSGEGERLDFLRDRHVRFFQRCLQVLPERYSSLETSRLTIAFFALSGLDMLDSLDVVNKDDIIEWIYSLQVLPTEDRSNLNRCGFRGSSYLGIPFNPSKAPGTAHPYDSGHIAMTYTGLSCLVILGDDLSRVNKEACLAGLRALQLEDGSFCAVPEGSENDMRFVYCASCICYMLNNWSGMDMKKAITYIRRSMSYDNGLAQGAGLESHGGSTFCGIASLCLMGKLEEVFSEKELNRIKRWCIMRQQNGYHGRPNKPVDTCYSFWVGATLKLLKIFQYTNFEKNRNYILSTQDRLVGGFAKWPDSHPDALHAYFGICGLSLMEESGICKVHPALNVSTRTSERLLDLHQSWKTKDSKQCSENVHIST

SEQ ID NO: 1200 - protein, 1224 aa, Homo sapiens
  misc_feature (0)...(0): Polypeptide Accession Number P53621
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCAVFHPRQELILSNSEDKSIRVWDMSKRTGVQTFRRDHDRFWVLAAHPNLNLFAAGHDGGMIVFKLERERPAYAVHGNMLHYVKDRFLRQLDFNSSKDVAVMQLRSGSKFPVFNMSYNPAENAVLLCTRASNLENSTYDLYTIPKDADSQNPDAPEGKRSSGLTAVWVARNRFAVLDRMHSLLIKNLKNEITKKVQVPNCDEIFYAGTGNLLLRDADSITLFDVQQKRTLASVKISKVKYVIWSADMSHVALLAKHAIVICNRKLDALCNIHENIRVKSGAWDESGVFIYTTSNHIKYAVTTGDHGIIRTLDLPIYVTRVKGNNVYCLDRECRPRVLTIDPTEFKFKLALINRKYDEVLHMVRNAKLVGQSIIAYLQKKGYPEVALHFVKDEKTRFSLALECGNIEIALEAAKALDDKNCWEKLGEVALLQGNHQIVEMCYQRTKNFDKVSFLYLITGNLEKLRKMMKIAEIRKDMSGHYQNALYLGDVSERVRILKNCGQKSLAYLTAATHGLDEEAESLKETFDPEKETIPDIDPNAKLLQPPAPIMPLDTNWPLLTVSKGFFEGTIASKGKGGALAADIDIDTVGTEGWGEDAELQLDEDGFVEATEGLGDDALGKGQEEGGGWDVEEDLELPPELDISPGAAGGAEDGFFVPPTKGTSPTQIWCNNSQLPVDHILAGSFETAMRLLHDQVGVIQFGPYKQLFLQTYARGRTTYQALPCLPSMYGYPNRNWKDAGLKNGVPAVGLKLNDLIQRLQLCYQLTTVGKFEEAVEKFRSILLSVPLLVVDNKQEIAEAQQLITICREYIVGLSVETERKKLPKETLEQQKRICEMAAYFTHSNLQPVHMILVLRTALNLFFKLKNFKTAATFARRLLELGPKPEVAQQTRKILSACEKNPTDAYQLNYDMHNPFDICAASYRPIYRGKPVEKCPLSGACYSPEFKGQICRVTTVTEIGKDVIGLRISPLQFR

SEQ ID NO: 1201 - protein, 418 aa, Homo sapiens
  misc_feature (0)...(0): Polypeptide Accession Number P53677
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTILRTVVNTITGSTNVGDQLPTGQLSVVPWRRTGVKYTNNEAYFDVIEEIDAIIDKSGSTITAEIQGVIDACVKLTGMPDLTLSFMNPRLLDDVSFHPCVRFKRWESERILSFIPPDGNFRLLSYHVSAQNLVAIPVYVKHNISFRDSSSLGRFEITVGPKQTMGKTIEGVTVTSQMPKGVLNMSLTPSQGTHTFDPVTKMLSWDVGKINPQKLPSLKGTMSLQAGASKPDENPTINLQFKIQQLAISGLKVNRLDMYGEKYKPFKGIKYMTKAGKFQVRT

SEQ ID NO: 1202 - protein, 142 aa, Homo sapiens
  misc_feature (0)...(0): Polypeptide Accession Number P53680
MIRFILIQNRAGKTRLAKWYMQFDDDEKQKLIEEVHAVVTVRDAKHTNFVEFRNFKIIYRRYAGLYFCICVDVNDNKLAYLEGIHNFVEVLNEYFHNVCELDLVFNFYKVYTVVDEMFLAGEIRETSQTKVLKQLLMLQSLE

SEQ ID NO: 1203 - protein, 367 aa, Homo sapiens
  misc_feature (0)...(0): Polypeptide Accession Number P53778
MSSPPPARSGFYRQEVTKTAWEVRAVYRDLQPVGSGAYGAVCSAVDGRTGAKVAIKKLYRPFQSELFAKRAYRELRLLKHMRHENVIGLLDVFTPDETLDDFTDFYLVMPFMGTDLGKLMKHEKLGEDRIQFLVYQMLKGLRYIHAAGIIHRDLKPGNLAVNEDCELKILDFGLARQADSEMTGYVVTRWYRAPEVILNWMRYTQTVDIWSVGCIMAEMITGKTLFKGSDHLDQLKEIMKVTGTPPAEFVQRLQSDEAKNYMKGLPELEKKDFASILTNASPLAVNLLEKMLVLDAEQRVTAGEALAHPYFESLHDTEDEPQVQKYDDSFDDVDRTLDEWKRVTYKEVLSFKPPRQLGARVSKETPL

SEQ ID NO: 1204 - protein, 464 aa, Homo sapiens
  misc_feature (0)...(0): Polypeptide Accession Number P53779
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 1205 - protein, 58 aa, Homo sapiens
  misc_feature (0)...(0): Polypeptide Accession Number P53803
MDTQKDVQPPKQQPMIYICGECHTENEIKSRDPIRCRECGYRIMYKKRTKRLVVFDAR

SEQ ID NO: 1206 - protein, 659 aa, Homo sapiens [sequence omitted]

SEQ ID NO: 1207 - protein, 360 aa, Homo sapiens
  misc_feature (0)...(0): Polypeptide Accession Number P54252
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERMLEANDGSGMLDEDEEDLQRALALSRQEIDMEDEEADLRRAIQLSMQGSSRNISQDMTQTSGTNLTSEELRKRREAYFEKQQQKQQQQQQQQQQQQQQQQQQQQQQRDLSGQSSHPCERPATSSGALGSDLGKACSPFIMFATFTLYLT

SEQ ID NO: 1208 - protein, 816 aa, Homo sapiens
  misc_feature (0)...(0): Polypeptide Accession Number P54253
MKSNQERSNECLPPKKREIPATSRSSEEKAPTLPSDNHRVEGTAWLPGNPGGRGHGGGRHGPAGTSVELGLQQGIGLHKALSTGLDYSPPSAPRSVPVATTLPAAYATPQPGTPVSPVQYAHLPHTFQFIGSSQYSGTYASFIPSQLIPPTANPVTSAVASAAGATTPSQRSQLEAYSTLLANMGSLSQTPGHKAEQQQQQQQQQQQQHQHQQQQQQQQQQQQQQQHLSRAPGLITPGSPPPAQQNQYVHISSSPQNTGRTASPPAIPVHLHPHQTMIPHTLTLGPPSQVVMQYADSGSHFVPREATKKAESSRLQQAIQAKEVLNGEMEKSRRYGAPSSADLGLGKAGGKSVPHPYESRHVVVHPSPSDYSSRDPSGVRASVMVLPNSNTPAADLEVQQATHREASPSTLNDKSGLHLGKPGHRSYALSPHTVIQTTHSASEPLPVGLPATAFYAGTQPPVIGYLSGQQQAITYAGSLPQHLVIPGTQPLLIPVGSTDMEASGAAPAIVTSSPQFAAVPHTFVTTALPKSENFNPEALVTQAAYPAMVQAQIHLPVVQSVASPAAAPPTLPPYFMKGSIIQLANGELKKVEDLKTEDFIQSAEISNDLKIDSSTVERIEDSHSPGVAVIQFAVGEHRAQVSVEVLVEYPFFVFGQGWSSCCPERTSQLFDLPCSKLSVGDVCISLTLKNLKNGSVKKGQPVDPASVLLKHSKADGLAGSRHRYAEQENGINQGSAQMLSENGELKFPEKMGLPAAPFLTKIEPSKPAATRKRRWSAPESRKLEKSEDEPPLTLPKPSLIPQEVKICIEGRSNVGK

SEQ ID NO: 1209 - protein, 1185 aa, Homo sapiens
  misc_feature (0)...(0): Polypeptide Accession Number P54259
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPYAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSARFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAGLGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 1210 - protein, 493 aa, Homo sapiens
  misc_feature (0)...(0): Polypeptide Accession Number P54578
PLYSVTVKWGKEKFEGVELNTDEPPMVFKAQLFALTGVQPARQKVMVKGGTLKDDDWGNIKIKNGMTLLMMGSADALPEEPSAKTVFVEDMTEEQLASAMELPCGLTNLGNTCYMNATVQCIRSVPELKDALKRYAGALRASGEMASAQYITAALRDLFDSMDKTSSSIPPIILLQFLHMAFPQFAEKGEQGQYLQQDANECWIQMMRVLQQKLEAIEDDSVKETDSSSASAATPSKKKSLIDQFFGVEFETTMKCTESEEEEVTKGKENQLQLSCFINQEVKYLFTGLKLRLQEEITKQSPTLQRNALYIKSSKISRLPAYLTIQMVRFFYKEKESVNAKVLKDVKFPLMLDMYELCTPELQEKMVSFRSKFKDLEDKKVNQQPNTSDKKSSPQKEVKYEPFSFADDIGSNNCGYYDLQAVLTHQGRSSSSGHYVSWVKRKQDEWIKFDDDKVSIVTPEDILRLSGGGDWHIAYVLLYGPRRVEIMEEESEQ

SEQ ID NO: 1211 - protein, 331 aa, Homo sapiens
  misc_feature (0)...(0): Polypeptide Accession Number P54619
METVISSDSSPAVENEHPQETPESNNSVYTSFMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 1212 - protein, 552 aa, Homo sapiens
  misc_feature (0)...(0): Polypeptide Accession Number P54646
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAHMNAKIADFGLSNMMSDGEFLRTSCGSPNYTAPEVISGRLYAGPEVDIWSCGVILYALLCGTLPFDDEHVPTLFKKIRGGVFYIPEYLNRSVATLLMHMLQVDPLKRATIKDIREHEWFKQGLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWRQGIRSQSKPYDIMAEVYRAMKQLDFEWKVVNAYHLRVRRKNPVTGNYVKMSLQLYLVDNRSYLLDFKSIDDEVVEQRSGSSTPQRSCSAAGLHRPRSSFDSTTAESHSLSGSLTGSLTGSTLSSVSPRLGSHTMDFFEMCASLITTLAR

SEQ ID NO: 1213 - protein, 363 aa, Homo sapiens
  misc_feature (0)...(0): Polypeptide Accession Number P54725
MAVTITLKTLQQQTFKIRMEPDETVKVLKEKIEAEKGRDAFPVAGQKLIYAGKILSDDVPIRDYRIDEKNFVVVMVTKTKAGQGTSAPPEASPTAAPESSTSFPPAPTSGMSHPPPAAREDKSPSEESAPTTSPESVSGSVPSSGSSGREEDAASTLVTGSEYETMLTEIMSMGYERERVVAALRASYNNPHRAVEYLLTGIPGSPEPEHGSVQESQVSEQPATEAAGENPLEFLRDQPQFQNMRQVIQQNPALLPALLQQLGQENPQLLQQISRHQEQFIQMLNEPPGELADISDVEGEVGAIGEEAPQMNYIQVTPQEKEAIERLKALGFPESLVIQAYFACEKNENLAANFLLSQNFDDE

SEQ ID NO: 1214 - protein, 409 aa, Homo sapiens
  misc_feature (0)...(0): Polypeptide Accession Number P54727
MQVTLKTLQQQTFKIDIDPEETVKALKEKIESEKGKDAFPVAGQKLIYAGKILNDDTALKEYKIDEKNFVVVMVTKPKAVSTPAPATTQQSAPASTTAVTSSTTTTVAQAPTPVPALAPTSTPASITPASATASSEPAPASAAKQEKPAEKPAETPVATSPTATDSTSGDSSRSNLFEDATSALVTGQSYENMVTEIMSMGYEREQVIAALRASFNNPDRAVEYLLMGIPGDRESQAVVDPPQAASTGAPQSSAVAAAAATTTATTTTTSSGGHPLEFLRNQPQFQQMRQIIQQNPSLLPALLQQIGRENPQLLQQISQHQEHFIQMLNEPVQEAGGQGGGGGGGSGGIAEAGSGHMNYIQVTPQEKEAIERLKALGFPEGLVIQAYFACEKNENLAANFLLQQNFDED

SEQ ID NO: 1215 - protein, 703 aa, Homo sapiens
  misc_feature (0)...(0): Polypeptide Accession Number P54840
MLRGRSLSVTSLGGLPQWEVEELPVEELLLFEVAWEVTNKVGGIYTVIQTKAKTTADEWGENYFLIGPYFEHNMKTQVEQCEPVNDAVRRAVDAMNKHGCQVHFGRWLIEGSPYVVLFDIGYSAWNLDRWKGDLWEACSVGIPYHDREANDMLIFGSLTAWFLKEVTDHADGKYVVAQFHEWQAGIGLILSRARKLPIATIFTTHATLLGRYLCAANIDFYNHLDKFNIDKEAGERQIYHRYCMERASVHCAHVFTTVSEITAIEAEHMLKRKPDVVTPNGLNVKKFSAVHEFQNLHAMYKARIQDFVRGHFYGHLDFDLEKTLFLFIAGRYEFSNKGADIFLESLSRLNFLLRMHKSDITVVVFFIMPAKTNNFNVETLKGQAVRKQLWDVAHSVKEKFGKKLYDALLRGEIPDLNDILDRDDLTIMKRAIFSTQRQSLPPVTTHNMIDDSTDPILSTIRRIGLFNNRTDRVKVILHPEFLSSTSPLLPMDYEEFVRGCHLGVFPSYYEPWGYTPAECTVMGIPSVTTNLSGFGCFMQEHVADPTAYGIYIVDRRFRSPDDSCNQLTKFLYGFCKQSRRQRIIQRNRTERLSDLLDWRYLGRYYQHARHLTLSRAFPDKFHVELTSPPTTEGFKYPRPSSVPPSPSGSQASSPQSSDVEDEVEDERYDEEEEAERDRLNIKSPFSLSHVPHGKKKLHGEYKN

SEQ ID NO: 1216 - protein, 439 aa, Homo sapiens
  misc_feature (0)...(0): Polypeptide Accession Number P55081
MSVPSALMKQPPIQSTAGAVPVRNEKGEISMEKVKVKRYVSGKRPDYAPMESSDEEDEEFQFIKKAKEQEAEPEEQEEDSSSDPRLRRLQNRISEDVEERLARHRKIVEPEVVGESDSEVEGDAWRMEREDSSEEEEEEIDDEEIERRRGMMRQRAQERKNEEMEVMEVEDEGRSGEESESESEYEEYTDSEDEMEPRLKPVFIRKKDRVTVQEREAEALKQKELEQEAKRMAEERRQYTLQIVGEETPKELEENKRSLAALDALNTDDENDEEEYEAWKVRELKRIKRDREDREALEKEKAEIERMRNLTEEERRAELRANGKVITNKAVKGKYKFLQKYYHRGAFFMDEDEEVYKRDFSAPTLEDHFNKTILPKVMQVKNFGRSGRTKYTHLVDQDTTSFDSAWGQESAQNTKFFKQKAAGVRDVFERPSAKKRKTT

SEQ ID NO: 1217 - protein, 474 aa, Homo sapiens
  misc_feature (0)...(0): Polypeptide Accession Number P55084
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKAQDEGLLSDVVPFKVPGKDTVTKDNGIRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAENYMGRKTKVGLPPLEKFNNWGGSLSLGHPFGATGCRLVMAAANRLRKEGGQYGLVAACAAGGQGHAMIVEAYPK

SEQ ID NO: 1218 - protein, 391 aa, Homo sapiens
  misc_feature (0)...(0): Polypeptide Accession Number P55209
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 1219 - protein, 166 aa, Homo sapiens
  misc_feature (0)...(0): Polypeptide Accession Number P55273
MLLEEVRAGDRLSGAAARGDVQEVRRLLHRELVHPDALNRFGKTALQVMMFGSTAIALELLKQGASPNVQDTSGTSPVHDAARTGFLDTLKVLVEHGADVNVPDGTGALPIHLAVQEGHTAVVSFLAAESDLHRRDARGLTPLELALQRGAQDLVDILQGHMVAPL

SEQ ID NO: 1220 - protein, 103 aa, Homo sapiens
  misc_feature (0)...(0): Polypeptide Accession Number P55854
MSEEKPKEGVKTENDHINLKVAGQDGSVVQFKIKRHTSLSKLMKAYCERQGLSMRQIRFRFDGQPINETDTPAQLRMEDEDTIDVFQQQTGGVPESSLAGHSF

SEQ ID NO: 1221 - protein, 95 aa, Homo sapiens
  misc_feature (0)...(0): Polypeptide Accession Number P55855
MADEKPKEGVKTENNDHINLKVAGQDGSVVQFKIKRHTPLSKLMKAYCERQGLSMRQIRFRFDGQPINETDTPAQLEMEDEDTIDVFQQQTGGVY

SEQ ID NO: 1222 - protein, 1084 aa, Homo sapiens
  misc_feature (0)...(0): Polypeptide Accession Number P56524
MSSQSHPDGLSGRDQPVELLNPARVNHMPSTVDVATALPLQVAPSAVPMDLRLDHQFSLPVAEPALREQQLQQELLALKQKQQIQRQILIAEFQRQHEQLSRQHEAQLHEHIKQQQEMLAMKHQQELLEHQRKLERHRQEQELEKQHREQKLQQLKNKEKGKESAVASTEVKMKLQEFVLNKKKALAHRNLNHCISSDPRYWYGKTQHSSLDQSSPPQSGVSTSYNHPVLGMYDAKDDFPLRKTASEPNLKLRSRLKQKVAERRSSPLLRRKDGPVVTALKKRPLDVTDSACSSAPGSGPSSPNNSSGSVSAENGIAPAVPSIPAETSLAHRLVAREGSAAPLPLYTSPSLPNITLGLPATGPSAGTAGQQDTERLTLPALQQRLSLFPGTHLTPYLSTSPLERDGGAAHSPLLQHMVLLEQPPAQAPLVTGLGALPLHAQSLVGADRVSPSIHKLRQHRPLGRTQSAPLPQNAQALQHLVIQQQHQQFLEKHKQQFQQQQLQMNKIIPKPSEPARQPESHPEETEEELREHQALLDEPYLDRLPGQKEAHAQAGVQVKQEPIESDEEEAEPPREVEPGQRQPSEQELLFRQQALLLEQQRIHQLRNYQASMEAAGIPVSFGGHRPLSRAQSSPASATFPVSVQEPPTKPRFTTGLVYDTLMLKHQCTCGSSSSHPEHAGRIQSIWSRLQETGLRGKCECIRGRKATLEELQTVHSEAHTLLYGTNPLNRQKLDSKKLLGSLASVFVRLPCGGVGVDSDTIWNEVHSAGAARLAVGCVVELVFKVATGELKNGFAVVRPPGHHAEESTPMGFCYFNSVAVAAKLLQQRLSVSKILIVDWDVHHGNGTQQAFYSDPSVLYMSLHRYDDGNFFPGSGAPDEVGTGPGVGFNVNMAFTGGLDPPMGDAEYLAAFRTVVMPIASEFAPDVVLVSSGFDAVEGHPTPLGGYNLSARCFGYLTKQLMGLAGGRIVLALEGGHDLTAICDASEACVSALLGNELDPLPEKVLQQRPNANAVRSMEKVMEIHSKYWRCLQRTTSTAGRSLIEAQTCENEEAETVTAMASLSVGVKPAEKRPDEEPMEEEPPL

SEQ ID NO: 1223 - protein, 445 aa, Homo sapiens
  misc_feature (0)...(0): Polypeptide Accession Number P56545
MALVDKHKVKRQRLDRICEGIRPQIMNGPLHPRPLVALLDGRDCTVEMPILKDLATVAFCDAQSTQEIHEKVLNEAVGAMMYHTITLTREDLEKFKALRVIVRIGSGYDNVDIKAAGELGIAVCNIPSAAVEETADSTICHILNLYRRNTWLYQALREGTRVQSVEQIREVASGAARIRGETLGLIGFGRTGQAVAVRAKAFGFSVIFYDPYLQDGIERSLGVQRVYTLQDLLYQSDCVSLHCNLNEHNHHLINDFTIKQMRQGAFLVNAARGGLVDEKALAQALKEGRIRGAALDVHESEPFSFAQGPLKDAPNLICTPHTAWYSEQASLEMREAAATEIRRAITGRIPESLRNCVNKEFFVTSAPWSVIDQQAIHPELNGATYRYPPGIVGVAPGGLPAAMEGIIPGGIPVTHNLPTVAHPSQAPSPNQPTKHGDNREHPNEQ

SEQ ID NO: 1224 - protein, 165 aa, Homo sapiens
  misc_feature (0)...(0): Polypeptide Accession Number P56554
MAGTALKRLMAEYKQLTLNPPEGIVAGPMNEENFFEWEALIMGPEDTCFEFGVFPAILSFPLDYPLSPPKMRFTCEMFHPNIYPDGRVCISILHAPGDDPMGYESSAERWSPVQSVEKILLSVVSMLAEPNDESGANVDASKMWRDDREQFYKIAKQIVQKSLGL

SEQ ID NO: 1225 - protein, 415 aa, Homo sapiens
  misc_feature (0)...(0): Polypeptide Accession Number P78368
MDFDKKGGKGETEEGRRMSKAGGGRSSHGIRSSGTSSGVLMVGPNFRVGKKIGCGNFGELRLGKNLYTNEYVAIKLEPIKSRAPQLHLEYRFYKQLSATEGVPQVYYFGPCGKYNAMVLELLGPSLEDLFDLCDRTFTLKTVLMIAIQLITRMEYVHTKSLIYRDVKPENFLVGRPGTKRQHAIHIIDFGLAKEYIDPETKKHIPYREHKSLTGTARYMSINTHLGKEQSRRDDLEALGHMFMYFLRGSLPWQGLKADTLKERYQKIGDTKRATPIEVLCENFPEEMATYLRYVRRLDFFEKPDYDYLRKLFTDLFDRSGFVFDYEYDWAGKPLPTPIGTVHTDLPSQPQLRDKTQPHSKNQALNSTNGELNADDPTAGHSNAPITAPAEVEVADETKCCCFFKRRKRKSLQRHK

SEQ ID NO: 1226 - protein, 368 aa, Homo sapiens
  misc_feature (0)...(0): Polypeptide Accession Number P78406
MSLFGTTSGFGTSGTSMFGSATTDNHNPMKDIEVTSSPDDSIGCLSFSPPTLPGNFLIAGSWANDVRCWEVQDSGQTIPKAQQMHTGPVLDVCWSDDGSKVFTASCDKTAKMWDLSSNQAIQIAQHDAPVKTIHWIKAPNYSCVMTGSWDKTLKFWDTRSSNPMMVLQLPERCYCADVIYPMAVVATAERGLIVYQLENQPSEFRRIESPLKHQHRCVAIFKDKQNKPTGFALGSIEGRVAIHYINPPNPAKDNFTFKCHRSNGTNTSAPQDIYAVNGIAFHPVHGTLATVGSDGRFSFWDKDARTKLKTSEQLDQPISACCFNHNGNIFAYASSYDWSKGHEFYNPQKKNYIFLRNAAEELKPRNKK

SEQ ID NO: 1227 - protein, 354 aa, Homo sapiens
  misc_feature (0)...(0): Polypeptide Accession Number P78540
MSLRGSLSRLLQTRVHSILKKSVHSVAVIGAPFSQGQKRKGVEHGPAAIREAGLMKRLSSLGCHLKDFGDLSFTPVPKDDLYNNLIVNPRSVGLANQELAEVVSRAVSDGYSCVTLGGDHSLAIGTISGHARHCPDLCVVWVDAHADINTPLTTSSGNLHGQPVSFLLRELQDKVPQLPGFSWIKPCISSASIVYIGLRDVDPPEHFILKNYDIQYFSMRDIDRLGIQKVMERTFDLLIGKRQRPIHLSFDIDAFDPTLAPATGTPVVGGLTYREGMYIAEEIHNTGLLSALDLVEVNPQLATSEEEAKTTANLAVDVIASSFGQTREGGHIVYDQLPTPSSPDESENQARVRI

SEQ ID NO: 1228 - protein, 103 aa, Homo sapiens
  misc_feature (0)...(0): Polypeptide Accession Number P80095
AGKAHRLSAEERDQLLPNLRAVGWNELEGRDAIFKQFHFKDFNRAFGFMTRVALQAEKLDHHPEWFNVYNKVHITLSTHECAGLSERDINLASFIEQVAVSMT

SEQ ID NO: 1229 - protein, 420 aa, Homo sapiens
  misc_feature (0)...(0): Polypeptide Accession Number P80303
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPHI

SEQ ID NO: 1230 - protein, 946 aa, Homo sapiens
  misc_feature (0)...(0): Polypeptide Accession Number P98171
MAAHGKLRRERGLQAEYETQVKEMRWQLSEQLRCLELQGELRRELLQELAEFMRRRAEVELEYSRGLEKLAERFSSRGGRLGSSREHQSFRKEPSLLSPLHCWAVLLQHTRQQSRESAALSEVLAGPLAQRLSHIAEDVGRLVKKSRDLEQQLQDELLEVVSELQTAKKTYQAYHMESVNAEAKLREAERQEEKRAGRSVPTTTAGATEAGPLRKSSLKKGGRLVEKRQAKFMEHKLKCTKARNEYLLSLASVNAAVSNYYLHDVLDLMDCCDTGFHLALGQVLRSYTAAESRTQASQVQGLGSLEEAVEALDPPGDKAKVLEVHATVFCPPLRFDYHPHDGDEVAEICVEMELRDEILPRAQNIQSRLDRQTIETEEVNKTLKATLQALLEVVASDDGDVLDSFQTSPSTESLKSTSSDPGSRQAGRRRGQQQETETFYLTKLQEYLSGRSILAKLQAKHEKLQEALQRGDKEEQEVSWTQYTQRKFQKSRQPRPSSQYNQRLFGGDMEKFIQSSGQPVPLVVESCIRFINLNGLQHEGIFRVSGAQLRVSEIRDAFERGEDPLVEGCTAHDLDSVAGVLKLYFRSLEPPLFPPDLFGELLASSELEDTAERVEHVSRLLWRLPAPVLVVLRYLFTFLNHLAQYSDENMMDPYNLAVCFGPTLLPVPAGQDPVALQGRVNQLVQTLIVQPDRVFPPLTSLPGPVYEKCMAPPSASCLGDAQLESLGADNDPELEAEMPAQEDDLEGVVEAVACFAYTGRTAQELSFRRGDVLRLHERASSDWWRGEHNGMRGLIPHKYITLPAGTEKQVVGAGLQTAGESGSSPEGLLASELVHRPEPCTSPEAMGPSGHRRRCLVPASPEQHVEVDKAVAQNMDSVFKELLGKTSVRQGLGPASTTSPSPGPRSPKAPPSSRLGRNKGFSRGPGAPASPSASHPQGLDTTPKPH

SEQ ID NO: 1231 - protein, 961 aa, Homo sapiens
  misc_feature (0)...(0): Polypeptide Accession Number P98174
MHGHRAPGGRRAFGARTPGHEPAGAAPPACADSDPGASEPGLLARRGSGSALGGPLDPQFVGPSDTSLGAAPGHRVLPCGPSPQHHRALRFSYHLEGSQPRPGLHQGNRILVKSLSLDPGQSLEPHPEGPQRLRSDPGPPTETPSQRPSPLKRAPGPKPQVPPKPSYLQMPRMPPPLEPIPPPPSRPLPADPRVGKGLAPRAEASPSSAAVSSLIEKFEREPVIVASDRPVPGPSPGPPEPVMLPQPTSQPPVPQLPEGEASRCLFLLAPGPRDGEKVPNRDSGIDSISSPSNSEETCFVSDDGPPSHSLCPGPPALASVPVALADPHRPGSQEVDSDLEEEDDEEEEEEKDREIPVPLMERQESVELTVQQKVFHIANELLQTEKAYVSRLHLLDQVFCARLLEEARNRSSFPADVVHGIFSNICSIYCFHQQFLLPELEKRMEEWDRYPRIGDILQKLAPFLKMYGEYVKNFDRAVELVNTWTERSTQFKVIIHEVQKEEACGNLTLQHHMLEPVQRIPRYELLLKDYLLKLPHGSPDSKDAQKSLELIATAAEHSNAAIRKMERMHKLLKVYELLGGEEDIVSPTKELIKEGHILKLSAKNGTTQDRYLILFNDRLLYCVPRLRLLGQKFSVRARIDVDGMELKESSNLNLPRTFLVSGKQRSLELQARTEEEKKDWVQAINSTLLKHEQTLETFKLLNSTNREDEDTPPNSPNVDLGKRAPTPIREKEVTMCMRCQEPFNSITKRRHHCKACGHVVCGKCSEFRARLVYDNNRSNRVCTDCYVALHGVPGSSPACSQHTPQRRRSILEKQASVAAENSVICSFLHYMEKGGKGWHKAWFVVPENEPLVLYIYGAPQDVKAQRSLPLIGFEVGPPEAGERPDRRHVFKITQSHLSWYFSPETEELQRRWMAVLGRAGRGDTFCPGPTLSEDREMEEAPVAALGATAEPPESPQTRDKT

SEQ ID NO: 1232 - protein, 929 aa, Homo sapiens
  misc_feature (0)...(0): Polypeptide Accession Number P98175
MEYERRGGRGDRTGRYGATDRSQDDGGENRSRDHDYRDMDYRSYPREYGSQEGKHDYDDSSEEQSAEDSYEASPGSETQRRRRRRHRHSPTGPPGFPRDGDYRDQDYRTEQGEEEEEEEDEEEEEKASNIVMLRMLPQAATEDDIRGQLQSHGVQAREVRLMRNKSSGQSRGFAFVEFSHLQDATRWMEANQHSLNILGQKVSMHYSDPKPKINEDWLCNKCGVQNFKRREKCFKCGVPKSEAEQKLPLGTRLDQQTLPLGGRELSQGLLPLPQPYQAQGVLASQALSQGSEPSSENANDTIILRNLNPHSTMDSILGALAPYAVLSSSNVRVIKDKQTQLNRGFAFIQLSTIEAAQLLQILQALHPPLTIDGKTINVEFAKGSKRDMASNEGSRISAASVASTAIAAAQWAISQASQGGEGTWATSEEPPVDYSYYQQDEGYGNSQGTESSLYAHGYLKGTKGPGITGTKGDPTGAGPEASLEPGADSVSMQAFSRPQPGAAPGIYQQSAEASSSQGTAANSQSYTIMSPAVLKSELQSPTHPSSALPPATSPTAQESYSQYPVPDVSTYQYDETSGYYYDPQTGLYYDPNSQYYYNAQSQQYLYWDGERRTYVPALEQSADGHKETGAPSKEGKEKKEKHKTKTAQQIAKDMERWARSLNKQKENFKNSFQPISSLRDDERRESATADAGYAILEKKGALAERQHTSMDLPKLASDDRPSPPRGLVAAYSGESDSEEEQERGGPEREEKLTDWQKLACLLCRRQFPSKEALIRHQQLSGLHKQNLEIHRRAHLSENELEALEKNDMEQMKYRDRAAERREKYGIPEPPEPKRRKYGGISTASVDFEQPTRDGLGSDNIGSRMLQAMGWKEGSGLGRKKQGIVTPIEAQTRVRGSGLGARGSSYGVTSTESYKETLHKTMVTRFNEAQ

SEQ ID NO: 1233 - protein, 157 aa, Homo sapiens
  misc_feature (0)...(0): Polypeptide Accession Number P98179
MSSEEGKLFVGGLNFNTDEQALEDHFSSFGPISEVVVVKDRETQRSRGFGFITFTNPEHASVAMRAMNGESLDGRQIRVDHAGKSARGTRGGGFGAHGRGRSYSRGGGDQGYGSGRYYDSRPGGYGYGYGRSRDYNGRNQGGYDRYSGGNYRDNYDN

SEQ ID NO: 1234 - protein, 246 aa, Homo sapiens
  misc_feature (0)...(0): Polypeptide Accession Number Q00059
MAFLRSMWGVLSALGRSGAELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKELYIQHAKEDETRYHNEMKSWEEQMIEVGRKDLLRRTIKKQRKYGAEEC

SEQ ID NO: 1235 - protein, 1268 aa, Homo sapiens
  misc_feature (0)...(0): Polypeptide Accession Number Q00341
MSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQDKRAVERLEVEKAFHPFIAGPYNRLVGEIMQETGTRINIPPPSVNRTEIVFTGEKEQLAQAVARIKKIYEEKKKKTTTIAVEVKKSQHKYVIGPKGNSLQEILERTGVSVEIPPSDSISETVILRGEPEKLGQALTEVYAKANSFTVSSVAAPSWLHRFIIGKKGQNLAKITQQMPKVHIEFTEGEDKITLEGPTEDVNVAQEQIEGMVKDLINRMDYVEINIDHKFHRHLIGKSGANINRIKDQYKVSVRIPPDSEKSNLIRIEGDPQGVQQAKRELLELASRMENERTKDLIIEQRFHRTIIGQKGERIREIRDKFPEVIINFPDPAQKSDIVQLRGPKNEVEKCTKYMQKMVADLVENSYSISVPIFKQFHKNIIGKGGANIKKIREESNTKIDLPAENSNSETIIITGKRANCEAARSRILSIQKDLANIAEVEVSIPAKLHNSLIGTKGRLIRSIMEECGGVHIHFPVEGSGSDTVVIRGPSSDVEKAKKQLLHLAEEKQTKSFTVDIRAKPEYHKFLIGKGGGKIRKVRDSTGARVIFPAAEDKDQDLITIIGKEDAVREAQKELEALIQNLDNVVEDSMLVDPKHHRHFVIRRGQVLREIAEEYGGVMVSFPRSGTQSDKVTLKGAKDCVEAAKKRIQEIIEDLEAQVTLECAIPQKFHRSVMGPKGSRIQQITRDFSVQIKFPDREENAVHSTEPVVQENGDEAGEGREAKDCDPGSPRRCDIIIISGRKEKCEAAKEALEALVPVTIEVEVPFDLHRYVIGQKGSGIRKMMDEFEVNIHVPAPELQSDIIAITGLAANLDRAKAGLLERVKELQAEQEDRALRSFKLSVTVDPKYHPKIIGRKGAVITQIRLEHDVNIQFPDKDDGNQPQDQITITGYEKNTEAARDAILRIVGELEQMVSEDVPLDHRVHARIIGARGKAIRKIMDEFKVDIRFPQSGAPDPNCVTVTGLPENVEEAIDHILNLEEEYLADVVDSEALQVYMKPPAHEEAKAPSRGFVVRDAPWTASSSEKAPDMSSSEEFPSFGAQVAPKTLPWGPKR

SEQ ID NO: 1236 - protein, 305 aa, Homo sapiens
  misc_feature (0)...(0): Polypeptide Accession Number Q00526
MDMFQKVEKIGEGTYGVVYKAKNRETGQLVALKKIRLDLEMEGVPSTAIREISLLKELKHPNIVRLLDVVHNERKLYLVFEFLSQDLKKYMDSTPGSELPLHLIKSYLFQLLQGVSFCHSHRVIHRDLKPQNLLINELGAIKLADFGLARAFGVPLRTYTHEVVTLWYRAPEILLGSKFYTTAVDIWSIGCIFAEMVTRKALFPGDSEIDQLFRIFRMLGTPSEDTWPGVTQLPDYKGSFPKWTRKGLEEIVPNLEPEGRDLLMQLLQYDPSQRITAKTALAHPYFSSPEPSPAARQYVLQRFRH

SEQ ID NO: 1237 - protein, 326 aa, Homo sapiens
  misc_feature (0)...(0): Polypeptide Accession Number Q00534
MEKDGLCRADQQYECVAEIGEGAYGKVFKARDLKNGGRFVALKRVRVQTGEEGMPLSTIREVAVLRHLETFEHPNVVRLFDVCTVSRTDRETKLTLVFEHVDQDLTTYLDKVPEPGVPTETIKDMMFQLLRGLDFLHSHRVVHRDLKPQNILVTSSGQIKLADFGLARIYSFQMALTSVVVTLWYRAPEVLLQSSYATPVDLWSVGCIFAEMFRRKPLFRGSSDVDQLGKILDVIGLPGEEDWPRDVALPRQAFHSKSAQPIEKFVTDIDELGKDLLLKCLTFNPAKRISAYSALSHPYFQDLERCKENLDSHLPPSQNTSELNTA

SEQ ID NO: 1238 - protein, 292 aa, Homo sapiens
  misc_feature (0)...(0): Polypeptide Accession Number Q00535
MQKYEKLEKIGEGTYGTVFKAKNRETHEIVALKRVRLDDDDEGVPSSALREICLLKELKHKNIVRLHDVLHSDKKLTLVFEFCDQDLKKYFDSCNGDLDPEIVKSFLFQLLKGLGFCHSRNVLHRDLKPQNLLINRNGELKLADFGLARAFGIPVRCYSAEVVTLWYRPPDVLFGAKLYSTSIDMWSAGCIFAELANAGRPLFPGNDVDDQLKRIFRLLGTPTEEQWPSMTKLPDYKPYPMYPATTSLVNVVPKLNATGRDLLQNLLKCNPVQRISAEEALQHPYFSDFCPP

SEQ ID NO: 1239 - protein, 496 aa, Homo sapiens [sequence omitted]

SEQ ID NO: 1240 - protein, 224 aa, Homo sapiens
  misc_feature (0)...(0): Polypeptide Accession Number Q00688
MAAAVPQRAWTVEQLRSEQLPKKDIIKFLQEHGSDSFLAEHKLLGNIKNVAKTANKDHLVTAYNHLFETKRFKGTESISKVSEQVKNVKLNEDKPKETKSEETLDEGPPKYTKSVLKKGDKTNFPKKGDVVHCWYTGTLQDGTVFDTNIQTSAKKKKNAKPLSFKVGVGKVIRGWDEALLTMSKGEKARLEIEPEWAYGKKGQPDAKIPPNAKLTFEVELVDID

SEQ ID NO: 1241 - protein, 356 aa, Homo sapiens
  misc_feature (0)...(0): Polypeptide Accession Number Q00796
AAAAKPNNLSLVVHGPGDLRLENYPIPEPGPNEVLLRMHSVGICGSDVHYWEYGRIGNFIVKKPMVLGHEASGTVEKVGSSVKHLKPGDRVAIEPGAPRENDEFCKMGRYNLSPSIFFCATPPDDGNLCRFYKHNAAFCYKLPDNVTFEEGALIEPLSVGIHACRRGGVTLGHKVLVCGAGPIGMVTLLVAKAMGAAQVVVTDLSATRLSKAKEIGADLVLQISKESPQEIARKVEGLLGCKPEVTIECTGAEASIQAGIYATRSGGTLVLVGLGSEMTTVPLLHAAIREVDIKGVFRYCNTWPVAISMLASKSVNVKPLVTHRFPLEKALEAFETFKKGLGLKIMLKCDPSDQNP

SEQ ID NO: 1242 - protein, 824 aa, Homo sapiens
  misc_feature (0)...(0): Polypeptide Accession Number Q00839
MSSSPVNVKKLKVSELKEELKKRRLSDKGLKAELMERLQAALDDEEAGGRPAMEPGNGSLDLGGDSAGRSGAGLEQEAAAGGDEEEEEEEEEEEGISALDGDQMELGEENGAAGAADSGPMEEEEAASEDENGDDQGFQEGEDELGDEEEGAGDENGHGEQQPQPPATQQQQPQQQRGAAKEAAGKSSGPTSLFAVTVAPPGARQGQQQAGGKKKAEGGGGGGRPGAPAGDGKTEQKGGDKKRGVKRPREDHGRGYFEYIEENKYSRAKSPQPPVEEEDEHFDDTVVCLDTYNCDLHFKISRDRLSASSLTMESFAFLWAGGRASYGVSKGKVCFEMKVTEKIPVRHLYTKDIDIHEVRIGWSLTTSGMLLGEEEFSYGYSLKGIKTCNCETEDYGEKFDENDVITCFANFESDEVELSYAKNGQDLGVAFKISKEVLAGRPLFPHVLCHNCAVEFNFGQKEKPYFPIPEEYTFIQNVPLEDRVRGPKGPEEKKDCEVVMMIGLPGAGKTTWVTKHAAENPGKYNILGTNTIMDKMMVAGFKKQMADTGKLNTLLQRAPQCLGKFIEIAARKKRNFILDQTNVSAAAQRRKMCLFAGFQRKAVVVCPKDEDYKQRTQKKAEVEGKDLPEHAVLKMKGNFTLPEVAECFDEITYVELQKEEAQKLLEQYKEESKKALPPEKKQNTGSKKSNKNKSGKNQFNRGGGHRGRGGLNMRGGNFRGGAPGNRGGYNRRGNMPQRGGGGGGSGGIGYPYPRAPVFPGRGSYSNRGNYNRGGMPNRGNYNQNFRGRGNNRGYKNQSQGYNQWQQGQFWGQKPWSQHYHQGYY

SEQ ID NO: 1243 - protein, 2364 aa, Homo sapiens
  misc_feature (0)...(0): Polypeptide Accession Number Q01082
MTTTVATDYDNIEIQQQYSDVNNRWDVDDWDNENSSARLFERSRIKALADEREAVQKKTFTKWVNSHLARVSCRITDLYTDLRDGRMLIKLLEVLSGERLPKPTKGRMRIHCLENVDKALQFLKEQRVHLENMGSHDIVDGNHRLTLGLIWTIILRFQIQDISVETEDNKEKKSAKDALLLWCQMKTAGYPNVNIHNFTTSWRDGMAFNALIHKHRPDLIDFDKLKKSNAHYNLQNAFNLAEQHLGLTKLLDPEDISVDHPDEKSIITYVVTYYHYFSKMKALAVEGKRIGKVLDNAIETEKMIEKYESLASDLLEWIEQTIIILNNRKFANSLVGVQQQLQAFNTYRTVEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKHLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPESERISMRQSKVDKLYAGLKDLAEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEEIKEKLLQLTEKRKEMIDKWEDRWEWLRLILEVHQFSRDASVAEAWLLGQEPYLSSREIGQSVDEVEKLIKRHEAFEKSAATWDERFSALERLTTLELLEVRRQQEEEERKRRPPSPEPSTKVSEEAESQQQWDTSKGEQVSQNGLPAEQGSPRMAETVDTSEMVNGATEQRTSSKESSPIPSPTSDRKAKTALPAQSAATLPARTQETPSAQMEGFLNRKHEWEAHNKKASSRSWHNVYCVINNQEMGFYKDAKTAASGIPYHSEVPVSLKEAVCEVALDYKKKKHVFKLRLNDGNEYLFQAKDDEEMNTWIQAISSAISSDKHEVSASTQSTPASSRAQTLPTSVVTITSESSPGKREKDKEKDKEKRFSLFGKKK

SEQ ID NO: 1244 - protein, 375 aa, Homo sapiens
  misc_feature (0)...(0): Polypeptide Accession Number Q01085
MMEDDGQPRTLYVGNLSRDVTEVLILQLFSQIGPCKSCKMITEHTSNDPYCFVEFYEHRDAAAALAAMNGRKILGKEVKVNWATTPSSQKKDTSNHFHVFVGDLSPEITTEDIKSAFAPFGKISDARVVKDMATGKSKGYGFVSFYNKLDAENAIVHMGGQWLGGRQIRTNWATRKPPAPKSTQENNTKQLRFEDVVNQSSPKNCTVYCGGIASGLTDQLMRQTFSPFGQIMEIRVFPEKGYSFVRFSTHESAAHAIVSVNGTTIEGHVVKCYWGKESPDMTKNFQQVDYSQWGQWSQVYGNPQQYGQYMANGWQVPPYGVYGQPWNQQGFGVDQSPSAAWMGGFGAQPPQGQAPPPVIPPPNQAGYGMASYQTQ

SEQ ID NO: 1245 - protein, 277 aa, Homo sapiens
  misc_feature (0)...(0): Polypeptide Accession Number Q01105
MSAPAAKVSKKELNSNHDGADETSEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEEEGLEDIDEEGDEDEGEEDEDDDEGEEGEEDEGEDD

SEQ ID NO: 1246 - protein, 3924 aa, Homo sapiens [sequence omitted]

SEQ ID NO: 1247 - protein, 253 aa, Homo sapiens [sequence omitted]

SEQ ID NO: 1248 - protein, 176 aa, Homo sapiens
  misc_feature (0)...(0): Polypeptide Accession Number Q01658
MASSSGNDDDLTIPRAAINKMIKETLPNVRVANDARELVVNCCTEFIHLISSEANEICNKSEKKTISPEHVIQALESLGFGSYISEVKEVLQECKTVALKRRKASSRLENLGIPEEELLRQQQELFAKARQQQAELAQQEWLQMQQAAQQAQLAAASASASNQAGSSQDEEDDDDI

SEQ ID NO: 1249 - protein, 763 aa, Homo sapiens
  misc_feature (0)...(0): Polypeptide Accession Number Q01826
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTYYANVSAAKCQEFGRWYKHFKKTKDMMVEMDSLSELSQQGANHVNFGQQPVPGNTAEQPPSPAQLSHGSQPSVRTPLPNLHPGLVSTPISPQLVNQQLVMAQLLNQQYAVNRLLAQQSLNQQYLNHPPPVSRSMNKPLEQQVSTNTEVSSEIYQWVRDELKRAGISQAVFARVAFNRTQGLLSEILRKEEDPKTASQSLLVNLRAMQNFLQLPEAERDRIYQDERERSLNAASAMGPAPLISTPPSRPPQVKTATIATERNGKPENNTMNINASIYDEIQQEMKRAKVSQALFAKVAATKSQGWLCELLRWKEDPSPENRTLWENLSMIRRFLSLPQPERDAIYEQESNAVHHHGDRPPHIIHVPAEQIQQQQQQQQQQQQQQQAPPPPQPQQQPQTGPRLPPRQPTVASPAESDEENRQKTRPRTKISVEALGILQSFIQDVGLYPDEEAIQTLSAQLDLPKYTIIKFFQNQRYYLKHHGKLKDNSGLEVDVAEYKEEELLKDLEESVQDKNTNTLFSVKLEEELSVEGNTDINTDLKD

SEQ ID NO: 1250 - protein, 656 aa, Homo sapiens
  misc_feature (0)...(0): Polypeptide Accession Number Q01844
MASTDYSTYSQAAAQQGYSAYTAQPTQGYAQTTQAYGQQSYGTYGQPTDVSYTQAQTTATYGQTAYATSYGQPPTGYTTPTAPQAYSQPVQGYGTGAYDTTTATVTTTQASYAAQSAYGTQPAYPAYGQQPAATAPTRPQDGNKPTETSQPQSSTGGYNQPSLGYGQSNYSYPQVPGSYPMQPVTAPPSYPPTSYSSTQPTSYDQSSYSQQNTYGQPSSYGQQSSYGQQSSYGQQPPTSYPPQTGSYSQAPSQYSQQSSSYGQQSSFRQDHPSSMGVYGQESGGFSGPGENRSMSGPDNRGRGRGGFDRGGMSRGGRGGGRGGMGSAGERGGFNKPGGPMDEGPDLDLGPPVDPDEDSDNSAIYVQGLNDSVTLDDLADFFKQCGVVKMNKRTGQPMIHIYLDKETGKPKGDATVSYEDPPTAKAAVEWFDGKDFQGSKLKVSLARKKPPMNSMRGGLPPREGRGMPPPLRGGPGGPGGPGGPMGRMGGRGGDRGGFPPRGPRGSRGNPSGGGNVQHRAGDWQCPNPGCGNQNFAWRTECNQCKAPKPEGFLPPPFPPPGGDRGRGGPGGMRGGRGGLMDRGGPGGMFRGGRGGDRGGFRGGRGMDRGGFGGGRRGGPGGPPGPLMEQMGGRRGGRGGPGKMDKGEHRQERRDRPY

SEQ ID NO: 1251 - protein, 507 aa, Homo sapiens
  misc_feature (0)...(0): Polypeptide Accession Number Q02078
MGRKKIQITRIMDERNRQVTFTKRKFGLMKKAYELSVLCDCEIALIIFNSSNKLFQYASTDMDKVLLKYTEYNEPHESRTNSDIVEALNKKEHRGCDSPDPDTSYVLTPHTEEKYKKINEEFDNMMRNHKIAPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLSEEEELELNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 1252 - protein, 2663 aa, Homo sapiens
  misc_feature (0)...(0): Polypeptide Accession Number Q02224
MAEEGAVAVCVRVRPLNSREESLGETAQVYWKTDNNVIYQVDGSKSFNFDRVFHGNETTKNVYEEIAAPIIDSAIQGYNGTIFAYGQTASGKTYTMMGSEDHLGVIPRAIHDIFQKIKKFPDREFLLRVSYMEIYNETITDLLCGTQKMKPLIIREDVNRNVYVADLTEEVVYTSEMALKWITKGEKSRHYGETKMNQRSSRSHTIFRMILESREKGEPSNCEGSVKVSHLNLVDLAGSERAAQTGAAGVRLKEGCNINRSLFILGQVIKKLSDGQVGGFINYRDSKLTRILQNSLGGNPKTRIICTITPVSFDETLTALQFASTAKYMKNTPYVNEVSTDEALLKRYRKEIMDLKKQLEEVSLETRAQAMEKDQLAQLLEEKDLLQKVQNEKIENLTRMLVTSSSLTLQQELKAKRKRRVTWCLGKINKMKNSNYADQFNIPTNITTKTHKLSINLLREIDESVCSESDVFSNTLDTLSEIEWNPATKLLNQENIESELNSLRADYDNLVLDYEQLRTEKEEMELKLKEKNDLDEFEALERKTKKDQEMQLIHEISNLKNLVKHREVYNQDLENELSSKVELLREKEDQIKKLQEYIDSQKLENIKMDLSYSLESIEDPKQMKQTLFDAETVALDAKRESAFLRSENLELKEKMKELATTYKQMENDIQLYQSQLEAKKKMQVDLEKELQSAFNEITKLTSLIDGKVPKDLLCNLELEGKITDLQKELNKEVEENEALREEVILLSELKSLPSEVERLRKEIQDKSEELHIITSEKDKLFSEVVHKESRVQGLLEEIGKTKDDLATTQSNYKSTDQEFQNFKTLHMDFEQKYKMVLEENERMNQEIVNLSKEAQKFDSSLGALKTELSYKTQELQEKTREVQERLNEMEQLKEQLENRDSPLQTVEREKTLITEKLQQTLEEVKTLTQEKDDLKQLQESLQIERDQLKSDIHDTVNMNIDTQEQLRNALESLKQHQETINTLKSKISEEVSRNLHMEENTGETKDEFQQKMVGIDKKQDLEAKNTQTLTADVKDNEIIEQQRKIFSLIQEKNELQQMLESVIAEKEQLKTDLKENIEMTIENQEELRLLGDELKKQQEIVAQEKNHAIKKEGELSRTCDRLAEVEEKLKEKSQQLQEKQQQLLNVQEEMSEMQKKINEIENLKNELKNKELTLEHMETERLELAQKLNENYEEVKSITKERKVLKELQKSFETERDHLRGYIREIEATGLQTKEELKIAHIHLKEHQETIDELRRSVSEKTAQIINTQDLEKSHTKLQEEIPVLHEEQELLPNVKKVSETQETMNELELLTEQSTTKDSTTLARIEMERLRLNEKFQESQEEIKSLTKERDNLKTIKEALEVKHDQLKEHIRETLAKIQESQSKQEQSLNMKEKDNETTKIVSEMEQFKPKDSALLRIEIEMLGLSKRLQESHDEMKSVAKEKDDLQRLQEVLQSESDQLKENIKEIVAKHLETEEELKVAHCCLKEQEETINELRVNLSEKETEISTIQKQLEAINDKLQNKIQEIYEKEEQLNIKQISEVQENVNELKQFKEHRKAKDSALQSIESKMLELTNRLQESQEEIQIMIKEKEEMKRVQEALQIERDQLKENTKEIVAKMKESQEKEYQFLKMTAVNETQEKMCEIEHLKEQFETQKLNLENIETENIRLTQILHENLEEMRSVTKERDDLRSVEETLKVERDQLKENLRETITRDLEKQEELKIVHMHLKEHQETIDKLRGIVSEKTNEISNMQKDLEHSNDALKAQDLKIQEELRIAHMHLKEQQETIDKLRGIVSEKTDKLSNMQKDLENSNAKLQEKIQELKANEHQLITLKKDVNETQKKVSEMEQLKKQIKDQSLTLSKLEIENLNLAQELHENLEEMKSVMKERDNLRRVEETLKLERDQLKESLQETKARDLEIQQELKTARMLSKEHKETVDKLREKISEKTIQISDIQKDLDKSKDELQKKIQELQKKELQLLRVKEDVNMSHKKINEMEQLKKQFEPNYLCKCEMDNFQLTKKLHESLEEIRIVAKERDELRRIKESLKMERDQFIATLREMIARDRQNHQVKPEKRLLSDGQQHLMESLREKCSRIKELLKRYSEMDDHYECLNRLSLDLEKEIEFHRIMKKLKYVLSYVTKIKEEQHECINKFEMDFIDEVEKQKELLIKIQHLQQDCDVPSRELRDLKLNQNMDLHIEEILKDFSESEFPSIKTEFQQVLSNRKEMTQFLEEWLNTRFDIEKLKNGIQKENDRICQVNNFFNNRIIAIMNESTEFEERSATISKEWEQDLKSLKEKNEKLFKNYQTLKTSLASGAQVNPTTQDNKNPHVTSRATQLTTEKIRELENSLHEAKESAMHKESKIIKMQKELEVTNDIIAKLQAKVHESNKCLEKTKETIQVLQDKVALGAKPYKEEIEDLKMKLVKIDLEKMKNAKEFEKEISATKATVEYQKEVIRLLRENLRRSQQAQDTSVISEHTDPQPSNKPLTCGGGSGIVQNTKALILKSEHIRLEKEISKLKQQNEQLIKQKNELLSNNQHLSNEVKTWKERTLKREAHKQVTCENSPKSPKVTGTASKKKQITPSQCKERNLQDPVPKESPKSCFFDSRSKSLPSPHPVRYFDNSSLGLCPEVQNAGAESVDSQPGPWHASSGKDVPECKTQ

SEQ ID NO: 1253 - protein, 344 aa, Homo sapiens
  misc_feature (0)...(0): Polypeptide Accession Number Q02338
MLATRTLSRPLSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVFRSEEVEKVVGDCPFEPEGPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYNPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 1254 - protein, 784 aa, Homo sapiens
  misc_feature (0)...(0): Polypeptide Accession Number Q02446
MSDQKKEEEEEAAAAAAMATEGGKTSEPENNNKKPKTSGSQDSQPSPLALLAATCSKIGTPGENQATGQQQIIIDPSQGLVQLQNQPQQLELVTTQLAGNAWQLVASTPPASKENNVSQPASSSSSSSSSNNGSASPTKTKSGNSSTPGQFQVIQVQNPSGSVQYQVIPQLQTVEGQQIQINPTSSSSLQDLQGQIKLISAGNNQAILTAANRTASGNILAQNLANQTVPVQIRPGVSIPLQLQTLPGTQAQVVTTLPINIGGVTLALPVINNVAAGGGTGQVGQPAATADSGTSNGNQLVSTPTNTTTSASTMPESPSSSTTCTTTASTSLTSSDTLVSSADTGQYASTSASSSERTIEESQTPAATESEAQSSSQLHANGMQNQQDQSNSLQQVQIVGQPILQQIQIQQPQQQIIQAIPPQSFQLQSGQTIQTIQQQPLQNVQLQAVNPTQVLIRAPTLTPSGQISWQTVQVQNIQSLSNLQVQNAGLSQQLTITPVSSSGGTTLAQIAPVAVAGAPITLNTAQLASVPNLQTVSVANLGAAGVQVQGVPVTITSVAGQQQGQDGVKVQQATIAPVTVAVGGIANATIGAVSPDQLTQVHLQQGQQTSDQEVQPGKRLRRVACSCPNCREGEGRGSNEPGKKKQHICHIEGCGKVYGKTSHLRAHLRWHTGERPFICNWMFCGKRFTRSDELQRHRRTHTGEKRFECPECSKRFMRSDHLSKHVKTHQNKKGGGTALAIVTSGELDSSVTEVLGSPRIVTVAAISQDSNPATPNVSTNMEEF

SEQ ID NO: 1255 - protein, 213 aa, Homo sapiens
  misc_feature (0)...(0): Polypeptide Accession Number Q02505
LITTSETPSHSTPSFTSSITTTEAPSSSTPSFTSSITTTDSIVTTETTYHSTPSFTSLITITETTSHSTPSYTTSITSTKTPSHSTPSYTTSITTTEIPSHSTPSFTSSIITTETTSHSTPSFTSSMFNSTASLTSSMTTTETTSHSTPSLTSSMTATETTSHSTPSFTSSITTTETTSNSTASLTSSITTTETTSNSTASLTSSMTTTETTS

SEQ ID NO: 1256 - protein, 351 aa, Homo sapiens
  misc_feature (0)...(0): Polypeptide Accession Number Q02547
MSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQLARADDYEQVKNVADYYPEYKLLFEGAGSNPGDKTLEDRFFEHEVKLNKLAFLNQFHFGVFYAFVKLKEQECRNIVWIAECIAQRHRAKIDNYIPIF

SEQ ID NO: 1257 - protein, 392 aa, Homo sapiens
  misc_feature (0)...(0): Polypeptide Accession Number Q02750
PKKKPTPIQLNPAPDGSAVNGTSSAETNLEALQKKLEELELDEQQRKRLEAFLTQKQKVGELKDDDFEKISELGAGNGGVVFKVSHKPSGLVMARKLIHLEIKPAIRNQIIRELQVLHECNSPYIVGFYGAFYSDGEISICMEHMDGGSLDQVLKKAGRIPEQILGKVSIAVIKGLTYLREKHKIMHRDVKPSNILVNSRGEIKLCDFGVSGQLIDSMANSFVGTRSYMSPERLQGTHYSVQSDIWSMGLSLVEMAVGRYPIPPPDAKELELMFGCQVEGDAAETPPRPRTPGRPLSSYGMDSRPPMAIFELLDYIVNEPPPKLPSGVFSLEFQDFVNKCLIKNPAERADLKQLMVHAFIKRSDAEEVDFAGWLCSTIGLNQPSTPTHAAGV

SEQ ID NO: 1258 - protein, 5179 aa, Homo sapiens
  misc_feature (0)...(0): Polypeptide Accession Number Q02817
MGLPLARLAAVCLALSLAGGSELQTEGRTRYHGRNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALEGGSHITTFDGKTYTFHGDCYYVLAKGDHNDSYALLGELAPCGSTDKQTCLKTVVLLADKKKNAVVFKSDGSVLLNQLQVNLPHVTASFSVFRPSSYHIMVSMAIGVRLQVQLAPVMQLFVTLDQASQGQVQGLCGNFNGLEGDDFKTASGLVEATGAGFANTWKAQSTCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTSFTTTTTTTTPTSSTVLSTTPKLCCLWSDWINEDHPSSGSDDGDREPFDGVCGAPEDIECRSVKDPHLSLEQHGQKVQCDVSVGFICKNEDQFGNGPFGLCYDYKIRVNCCWPMDKCITTPSPPTTTPSPPPTTTTTLPPTTTPSPPTTTTTTPPPTTTPSPPITTTTTPLPTTTPSPPISTTTTPPPTTTPSPPTTTPSPPTTTPSPPTTTTTTPPPTTTPSPPMTTPITPPASTTTLPPTTTPSPPTTTTTTPPPTTTPSPPTTTPITPPTSTTTLPPTTTPSPPPTTTTTPPPTTTPSPPTTTTPSPPTITTTTPPPTTTPSPPTTTTTTPPPTTTPSPPTTTPITPPTSTTTLPPTTTPSPPPTTTTTPPPTTTPSPPTTTTPSPPITTTTTPPPTTTPSSPITTTPSPPTTTMTTPSPTTTPSSPITTTTTPSSTTTPSPPPTTMTTPSPTTTPSPPTTTMTTLPPTTTSSPLTTTPLPPSITPPTFSPFSTTTPTTPCVPLCNWTGWLDSGKPNFHKPGGDTELIGDVCGPGWAANISCRATMYPDVPIGQLGQTVVCDVSVGLICKNEDQKPGGVIPMAFCLNYEINVQCCECVTQPTTMTTTTTENPTPPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTPTTTPITTTTTVTPTPTPTGTQTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRVPCSTVPVTTEVSYAGCTKTVLMNHCSGSCGTFVMYSAKAQALDHSCSCCKEEKTSQREVVLSCPNGGSLTHTYTHIESCQCQDTVCGLPTGTSRRARRSPRHLGSG

SEQ ID NO: 1259 - protein, 550 aa, Homo sapiens [sequence omitted]

SEQ ID NO: 1260 - protein, 2704 aa, Homo sapiens
  misc_feature (0)...(0): Polypeptide Accession Number Q03001
MHSSSYSYRSSDSVFSNTTSTRTSLDSNENLLLVHCGPTLINSCISFGSESFDGHRLEMLQQIANRVQRDSVICEDKLILAGNALQSDSKRLESGVQFQNEAEIAGYILECENLLRQHVIDVQILIDGKYYQADQLVQRVAKLRDEIMALRNECSSVYSKGRILTTEQTKLMISGITQSLNSGFAQTLHPSLTSGLTQSLTPSLTSSSMTSGLSSGMTSRLTPSVTPAYTPGFPSGLVPNFSSGVEPNSLQTLKLMQIRKPLLKSSLLDQNLTEEEINMKFVQDLLNWVDEMQVQLDRTEWGSDLPSVESHLENHKNVHRAIEEFESSLKEAKISEIQMTAPLKLTYAEKLHRLESQYAKLLFSLLKNTSRNQERHLDTLHNFVSRATNELIWLNEKEEEEVAYDWSERNTNIARKKDYHAELMRELDQKEENIKSVQEIAEQLLLENHPARLTIEVKLESVMVLVEYAYRAAMQTQWSWILQLCQCVEQHIKENTAYFEFFNDAKEATDYLRNLKDAIQRKYSCDRSSSIHKLEDLVQESMEEKEELLQYKSTIANLMGKAKTIIQLKPRNSDCPLKTSIPIKAICDYRQIEITIYKDDECVLANNSHRAKWKVISPTGNEAMVPSVCFTVPPPNKEAVDLANRIEQQYQNVLTLWHESHINMKSVVSWHYLINEIDRIRASNVASVSMNLIKTMLPGEHQQVLSNLQSRFEDFLEDSQESQVFSGSDITQLEKEVNVCKQYYQELLKSAEREEQEESVYNLYISEVRNIRLRLENCEDRLIRQIRTPLERDDLHESVFRITEQEKLKKELERLKDDLGTITNKCEEFFSQAAASSSVPTLRSELNVVLQNMNQVYSMSSTYIDKYVTAISIYKGYCLISFLRLKTVNLVLKNTQAAEALVKLYETKLCEEEAVIADKNNIENLISTLKQWRSEVDEKRQVFHALEDELQKAKAISDEMFKTYKERDLDFDWHKEKADQLVERWQNVHVQIDNRLRDLEGIGKSLKYYRDTYHPLDDWIQQVETTQRKIQENQPENSKTLATQLNQQKMLVSEIEMKQSKMDECQKYAEQYSATVKDYELQTMTYRAMVDSQQKSPVKRRRMQSSADLIIQEFMDLRTRYTALVTLMTQYIKFAGDSLKRLEEEEVIINSEHPVNIKELEIKRCKETSEHGAYSDLLQRQKATVLENSKLTGKISELERMVAELKKQKSRVEEELPKVREAAENELRKQQRNVEDISLQKIRAESEAKQYRRELETIVREKEAAERELERVRQLTIEAEAKRAAVEENLLNFRNQLEENTFTRRTLEDHLKRKDLSLNDLEQQKNKLMEELRRKRDNEEELLKLIKQMEKDLAFQKQVAEKQLKEKQKIELEARRKITEIQYTCRENALPVCPITQATSCRAVTGLQQEHDKQKAEELKQQVDELTAANRKAEQDMRELTYELNALQLEKTSSEEKARLLKDKLDETNNTLRCLKLELERKDQAEKGYSQQLRELGRQLNQTTGKAEEAMQEASDLKKIKRNYQLELESLNHEKGKLQREVDRITRAHAVAEKNIQHLNSQIHSFRDEKELERLQICQRKSDHLKEQFEKSHEQLLQNIKAEKENNDKIQRLNEELEKSNECAEMLKQKVEELTRQNNETKLMMQRIQAESENIVLEKQTIQQRCEALKIQADGFKDQLRSTNEHLHKQTKTEQDFQRKIKCLEEDLAKSQNLVSEFKQKCDQQNIIIQNTKKEVRNLNAELNASKEEKRRGEQKVQLQQAQVQELNNRLKKVQDELHLKTIEEQMTHRKMVLFQEESGKFKQSAEEFRKKMEKLMESKVITENDISGIRLDFVSLQQENSRAQENAKLCETNIKELERQLQQYREQMQQGQHMEANHYQKCQKLEDELIAQKREVENLKQKMDQQIKEHEHQLVLLQCEIQKKSTAKDCTFKPDFEMTVKECQHSGELSSRNTGHLHPTPRSPLLRWTQEPQPLEEKWQHRVVEQIPKEVQFQPPGAPLEKEKSQQCYSEYFSQTSTELQITFDETNPITRLSEIEKIRDQALNNSRPPVRYQDNACEMELVKVLTPLEIAKNKQYDMHTEVTTLKQEKNPVPSAEEWMLEGCRASGGLKKGDFLKKGLEPETFQNFDGDHACSVRDDEFKFQGLRHTVTARQLVEAKLLDMRTIEQLRLGLKTVEEVQKTLNKFLTKATSIAGLYLESTKEKISFASAAERIIIDKMVALAFLEAQAATGFIIDPISGQTYSVEDAVLKGVVDPEFRIRLLEAEKAAVGYSYSSKTLSVFQAMENRMLDRQKGKHILEAQIASGGVIDPVRGIRVPPEIALQQGLLNNAILQFLHEPSSNTRVFPNPNNKQALYYSELLRMCVFDVESQCFLFPFGERNISNLNVKKTHRISVVDTKTGSELTVYEAFQRNLIEKSIYLELSGQQYQWKEAMFFESYGHSSHMLTDTKTGLHFNINEAIEQGTIDKALVKKYQEGLITLTELADSLLSRLVPKKDLHSPVAGYWLTASGERISVLKASRRNLVDRITALRCLEAQVSTGGIIDPLTGKKYRVAEALHRGLVDEGFAQQLRQCELVITGIGHPITNKMMSVVEAVNANIINKEMGIRCLEFQYLTGGLIEPQVHSRLSIEEALQVGIIDVLIATKLKDQKSYVRNIICPQTKRKLTYKEALEKADFDFHTGLKLLEVSEPLMTGISSLYYSS

SEQ ID NO: 1261 - protein, 559 aa, Homo sapiens
  misc_feature (0)...(0): Polypeptide Accession Number Q03111
MDNQCTVQVRLELGHRAQLRKKPTTEGFTHDWMVFVRGPEQCDIQHFVEKVVFWLHDSFPKPRRVCKEPPYKVEESGYAGFIMPIEVHFKNKEEPRKVCFTYDLFLNLEGNPPVNHLRCEKLTFNNPTTEFRYKLLRAGGVMVMPEGADTVSRPSPDYPMLPTIPLSAFSDPKKTKPSHGSKDANKESSKTSKPHKVTKEHRERPRKDSESKSSSKELEREQAKSSKDTSRKLGEGRLPKEEKAPPPKAAFKEPKMALKETKLESTSPNPGPPPPPPPPPRASSKRPATADSPKPSAKKQKKSSSKGSRSAPGTSPRTSSSSSFSDKKPAKDKSSTRGEKVKAESEPREAKKALEVEESNSEDEASFKSESAQSSPSNSSSSSDSSSDSDFEPSQNHSQGPLRSMVEDLQSEESDEDDSSSGEEAAGKTNPGRDSRLSFSDSESDNSADSSLPSREPPPPQKPPPPNSKVSGRRSPESCSKPEKILKKGTYDKAYTDELVELHRRLMALRERNVLQQIVNLIEETGHFNVTNTTFDFDLFSLDETTVRKLQSCLEAVAT

SEQ ID NO: 1262 - protein, 3969 aa, Homo sapiens
  misc_feature (0)...(0): Polypeptide Accession Number Q03164
MAHSCRWRFPARPGTTGGGGGGGRRGLGGXPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNRARFINHSCEPNCYSRVINIDGQKHIVIFAMRKIYRGEELTYDYKFPIEDASNKLPCNCGAKKCRKFLN

SEQ ID NO: 1263 - protein, 1493 aa, Homo sapiens
  misc_feature (0)...(0): Polypeptide Accession Number Q03468
MPNEGIPHSSQTQEQDCLQSQPVSNNEEMAIKQESGGDGEVEEYLSFRSVGDGLSTSAVGCASAAPRRGPALLHIDRHQIQAVEPSAQALELQGLGVDVYDQDVLEQGVLQQVDNAIHEASRASQLVDVEKEYRSVLDDLTSCTTSLRQINKIIEQLSPQAATSRDINRKLDSVKRQKYNKEQQLKKITAKQKHLQAILGGAEVKIELDHASLEEDAEPGPSSLGSMLMPVQETAWEELIRTGQMTPFGTQIPQKQEKKPRKIMLNEASGFEKYLADQAKLSFERKKQGCNKRAARKAPAPVTPPAPVQNKNKPNKKARVLSKKEERLKKHIKKLQKRALQFQGKVGLPKARRPWESDMRPEAEGDSEGEESEYFPTEEEEEEEDDEVEGAEADLSGDGTDYELKPLPKGGKRQKKVPVQEIDDDFFPSSGEEAEAASVGEGGGGGRKVGRYRDDGDEDYYKQRLRRWNKLRLQDKEKRLKLEDDSEESDAEFDEGFKVPGFLFKKLFKYQQTGVRWLWELHCQQAGGILGDEMGLGKTIQIIAFLAGLSYSKIRTRGSNYRFEGLGPTVIVCPTTVMHQWVKEFHTWWPPFRVAILHETGSYTHKKEKLIRDVAHCHGILITSYSYIRLMQDDISRYDWHYVILDEGHKIRNPNAAVTLACKQFRTPHRIILSGSPMQNNLRELWSLFDFIFPGKLGTLPVFMEQFSVPITMGGYSNASPVQVKTAYKCACVLRDTINPYLLRRMKSDVKMSLSLPDKNEQVLFCRLTDEQHKVYQNFVDSKEVYRILNGEMQIFSGLIALRKICNHPDLFSGGPKNLKGLPDDELEEDQFGYWKRSGKMIVVESLLKIWHKQGQRVLLFSQSRQMLDILEVFLRAQKYTYLKMDGTTTIASRQPLITRYNEDTSIFVFLLTTRVGGLGVNLTGANRVVIYDPDWNPSTDTQARERAWRIGQKKQVTVYRLLTAGTIEEKIYHRQIFKQFLTNRVLKDPKQRRFFKSNDLYELFTLTSPDASQSTETSAIFAGTGSDVQTPKCHLKRRIQPAFGADHDVPKRKKFPASNISVNDATSSEEKSEAKGAEVNAVTSNRSDPLKDDPHMSSNVTSNDRLGEETNAVSGPEELSVISGNGECSNSSGTGKTSMPSGDESIDEKLGLSYKRERPSQAQTEAFWENKQMENNFYKHKSKTKHHSVAEEETLEKHLRPKQKPKNSKHCRDAKFEGTRIPHLVKKRRYQKQDSENKSEAKEQSNDDYVLEKLFKKSVGVHSVMKHDAIMDGASPDYVLVEAEANRVAQDALKALRLSRQRCLGAVSGVPTWTGHRGISGAPAGKKSRFGKKRNSNFSVQHPSSTSPTEKCQDGIMKKEGKDNVPEHFSGRAEDADSSSGPLASSSLLAKMRARNHLILPERLESESGHLQEASALLPTTEHDDLLVEMRNFIAFQAHTDGQASTREILQEFESKLSASQSCVFRELLRNLCTFHRTSGGEGIWKLKPEYC

SEQ ID NO: 1264 - protein, 440 aa, Homo sapiens [sequence omitted]

SEQ ID NO: 1265 - protein, 770 aa, Homo sapiens
  misc_feature (0)...(0): Polypeptide Accession Number Q04724
MFPQSRHPTPHQAAGQPFKFTIPESLDRIKEEFQFLQAQYHSLKLECEKLASEKTEMQRHYVMYYEMSYGLNIEMHKQTEIAKRLNTICAQVIPFLSQEHQQQVAQAVERAKQVTMAELNAIIGQQQLQAQHLSHGHGPPVPLTPHPSGLQPPGIPPLGGSAGLLALSSALSGQSHLAIKDDKKHHDAEHHRDREPGTSNSLLVPDSLRGTDKRRNGPEFSNDIKKRKVDDKDSSHYDSDGDKSDDNLVVDVSNEDPSSPRASPAHSPRENGIDKNRLLKKDASSSPASTASSASSTSLKSKEMSLHEKASTPVLKSSTPTPRSDMPTPGTSATPGLRPGLGKPPAIDPLVNQAAAGLRTPLAVPGPYPAPFGMVPHAGMNGELTSPGAAYASLHNMSPQMSAAAARGRRGRYGRSPMVGFDPPPHMRVPTIPPNLAGIPGGKPAYSFHVTADGQMQPVPFPPTPLIGPGIPRHARQINTLNHGEVVCAVTISNPTRHVYTGGKGCVKVWDISHPGNKSPVSQLDCLNRDNYIRSCKLLPDGCTLIVGGEASTLSIWDLAAPTPRIKAELTSSAPACYALAISPDSKVCFSCCSDGNIAVWDLHNQTLVRQFQGHTDGASCIDISNDGTKLWTGGLDNTVRSWDLREGRQLQQHDFTSQIFSLGYCPTGEWLAVGMESSNVEVLHVNKPDKYQLHLHESCVLSLKFAYCGKWFVSTGKDNLLNAWRTPYGASIFQSKESSSVLSCDISVDDKYIVTGSGDKKATVYEVIY

SEQ ID NO: 1266 - protein, 706 aa, Homo sapiens [sequence omitted]

SEQ ID NO: 1267 - protein, 431 aa, Homo sapiens
  misc_feature (0)...(0): Polypeptide Accession Number Q05048
MYRTKVGLKDRQQLYKLIISQLLYDGYISIANGLINEIKPQSVCAPSEQLLHLIKLGMENDDTAVQYAIGRSDTVAPGTGIDLEFDADVQTMSPEASEYETCYVTSHKGPCRVATYSRDGQLIATGSADASIKILDTERMLAKSAMPIEVMMNETAQQNMENHPVIRTLYDHVDEVTCLAFHPTEQILASGSRDYTLKLFDYSKPSAKRAFKYIQEAEMLRSISFHPSGDFILVGTQHPTLRLYDINTFQCFVSCNPQDQHTDAICSVNYNSSANMYVTGSKDGCIKLWDGVSNRCITTFEKAHDGAEVCSAIFSKNSKYILSSGKDSVAKLWEISTGRTLVRYTGAGLSGRQVHRTQAVFNHTEDYVLLPDERTISLCCWDSRTAERRNLLSLGHNNIVRCIVHSPTNPGFMTCSDDFRARFWYRRSTTD

SEQ ID NO: 1268 - protein, 864 aa, Homo sapiens
  misc_feature (0)...(0): Polypeptide Accession Number Q05193
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGNINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPSRSGQASPSRPESPRPPFDL

SEQ ID NO: 1269 - protein, 486 aa, Homo sapiens [sequence omitted]

SEQ ID NO: 1270 - protein, 673 aa, Homo sapiens
  misc_feature (0)...(0): Polypeptide Accession Number Q05516
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDRKARYLKNIFISKHSSEESGYASVAGQSLPGPMVDQSPSVSTSFGLSAMSPTKAAVDSLMTIGQSLLQGTLQPPAGPEEPTLAGGGRHPGVAEVKTEMMQVDEVPSQDSPGAAESSISGGMGDKVEERGKEGPGTPTRSSVITSARELHYGREESAEQVPPPAEAGQAPTGRPEHPAPPPEKHLGIYSVLPNHKADAVLSMPSSVTSGLHVQPALAVSMDFSTYGGLLPQGFIQRELFSKLGELAVGMKSESRTIGEQCSVCGVELPDNEAVEQHRKLHSGMKTYGCELCGKRFLDSLRLRMHLLAHSAGAKAFVCDQCGAQFSKEDALETHRQTHTGTDMAVFCLLCGKRFQAQSALQQHMEVHAGVRSYICSECNRTFPSHTALKRHLRSHTGDHPYECEFCGSCFRDESTLKSHKRIHTGEKPYECNGCDKKFSLKHQLETHYRVHTGEKPFECKLCHQRSRDYSAMIKHLRTHNGASPYQCTICTEYCPSLSSMQKHMKGHKPEEIPPDWRIEKTYLYLCYV

SEQ ID NO: 1271 - protein, 793 aa, Homo sapiens
  misc_feature (0)...(0): Polypeptide Accession Number Q05682
MDDFERRRELRRQKREEMRLEAERIAYQRNDDDEEEAARERRRRARQERLRQKQEEESLGQVTDQVEVNAQNSVPDEEAKTTTTNTQVEGDDEAAFLERLARREERRQKRLQEALERQKEFDPTITDASLSLPSRRMQNDTAENETTEKEEKSESRQERYEIEETETVTKSYQKNDWRDAEENKKEDKEKEEEEEEKPKRGSIGENQVEVMVEEKTTESQEETVVMSLKNGQISSEEPKQEEEREQGSDEISHHEKMEEEDKERAEAERARLEAEERERIKAEQDKKIADERARIEAEEKAAAQERERREAEERERMREEEKRAAEERQRIKEEEKRAAEERQRIKEEEKRAAEERQRIKEEEKRAAEERQRARAEEEEKAKVEEQKRNKQLEEKKRAMQETKIKGEKVEQKIEGKWVNEKKAQEDKLQTAVLKKQGEEKGTKVQAKREKLQEDKPTFKKEEIKDEKIKKDKEPKEEVKSFMDRKKGFTEVKSQNGEFMTHKLKHTENTFSRPGGRASVDTKEAEGAPQVEAGKRLEELRRRRGETESEEFEKLKQKQQEAALELEELKKKREERRKVLEEEEQRRKQEEADRKLREEEEKRRLKEEIERRRAEAAEKRQKMPEDGLSDDKKPFKCFTPKGSSLKIEERAEFLNKSVQKSSGVKSTHQAAIVSKIDSRLEQYTSAIEGTKSAKPTKPAASDLPVPAEGVRNIKSMWEKGNVFSSPTAAGTPNKETAGLKVGVSSRINEWLTKTPDGNKSPAPKPSDLRPGDVSSKRNLWEKQSVDKVTSPTKV

SEQ ID NO: 1272 - protein, 763 aa, Homo sapiens
  misc_feature (0)...(0): Polypeptide Accession Number Q06481
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPELYHPMKKGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 1273 - protein, 383 aa, Homo sapiens
  misc_feature (0)...(0): Polypeptide Accession Number Q06547
MSLVDLGKKLLEAARAGQDDEVRILMANGAPFTTDWLGTSPLHLAAQYGHYSTTEVLLRAGVSRDARTKVDRTPLHMAASEGHASIVEVLLKHGADVNAKDMLKMTALHWATEHNHQEVVELLIKYGADVHTQSKFCKTAFDISIDNGNEDLAEILQIAMQNQINTNPESPDTVTIHAATPQFIIGPGGVVNLTDETGVSAVQFGNSSTSVLATLAALAEASAPLSNSSETPVVATEEVVTAESVDGAIQQVVSSGGQQVITIVTDGIQLGNLHSIPTSGIGQPIIVTMPDGQQVLTVPATDIAEETVISEEPPAKRQCIEIIENRVESAEIEEREALQKQLDEANREAQKYRQQLLKKEQEAEAYRQKLEAMTRLQTNKEAV

SEQ ID NO: 1274 - protein, 339 aa, Homo sapiens
  misc_feature (0)...(0): Polypeptide Accession Number Q06609
MAMQMQLEANADTSVEEESFGPQPISRLEQCGINANDVKKLEEAGFHTVEAVAYAPKKELINIKGISEAKADKILAEAAKLVPMGFTTATEFHQRRSEIIQITTGSKELDKLLQGGIETGSITEMFGEFRTGKTQICHTLAVTCQLPIDRGGGEGKAMYIDTEGTFRPERLLAVAERYGLSGSDVLDNVAYARAFNTDHQTQLLYQASAMMVESRYALLIVDSATALYRTDYSGRGELSARQMHLARFLRMLLRLADEFGVAVVITNQVVAQVDGAAMFAADPKKPIGGNIIAHASTTRLYLRKGRGETRICKIYDSPCLPEAEAMFAINADGVGDAKD

SEQ ID NO: 1275 - protein, 810 aa, Homo sapiens
  misc_feature (0)...(0): Polypeptide Accession Number Q06730
MNKVEQKSQESVSFKDVTVGFTQEEWQHLDPSQRALYRDVMLENYSNLVSVGYCVHKPEVIFRLQQGEEPWKQEEEFPSQSFPVWTADHLKERSQENQSKHLWEVVFINNEMLTKEQGDVIGIPFNVDVSSFPSRKMFCQCDSCGMSFNTVSELVISKINYLGKKSDEFNACGKLLLNIKHDETHTQEKNEVLKNRNTLSHHEETLQHEKIQTLEHNFEYSICQETLLEKAVFNTQKRENAEENNCDYNEFGRTLCDSSSLLFHQISPSRDNHYEFSDCEKFLCVKSTLSKPHGVSMKHYDCGESGNNFRRKLCLSHLQKGDKGEKHFECNECGKAFWEKSHLTRHQRVHTGQKPFQCNECEKAFWDKSNLTKHQRSHTGEKPFECNECGKAFSHKSALTLHQRTHTGEKPYQCNACGKTFCQKSDLTKHQRTHTGLKPYECYECGKSFRVTSHLKVHQRTHTGEKPFECLECGKSFSEKSNLTQHQRIHIGDKSYECNACGKTFYHKSLLTRHQIIHTGWKPYECYECGKTFCLKSDLTVHQRTHTGQKPFACPECGKFFSHKSTLSQHYRTHTGEKPYECHECGKIFYNKSYLTKHNRTHTGEKPYECNECGKAFYQKSQLTQHQRIHIGEKPYKCNECGKAFCHKSALIVHQRTHTQEKPYKCNECGKSFCVKSGLIFHERKHTGEKPYECNECGKFFRHKSSLTVHHRAHTGEKSCQCNECGKIFYRKSELAQHQRSHTGEKPYECNTCRKTFSQKSNLIVHQRRHIGENLMNEMDIRNFQPQVSLHNASEYSHCGESPDDILNVQ

SEQ ID NO: 1276 - protein, 376 aa, Homo sapiens [sequence omitted]

SEQ ID NO: 1277 - protein, 199 aa, Homo sapiens
  misc_feature (0)...(0): Polypeptide Accession Number Q06830
MSSGNAKIGHPAPNFKATAVMPDGQFKDISLSDYKGKYVVFFFYPLDFTFVCPTEIIAFSDRAEEFKKLNCQVIGASVDSHFCHLAWVNTPKKQGGLGPMNIPLVSDPKRTIAQDYGVLKADEGISFRGLFIIDDKGILRQITVNDLPVGRSVDETLRLVQAFQFTDKHGEVCPAGWKPGSDTIKPDVQKSKEYFSKQK

SEQ ID NO: 1278 - protein, 387 aa, Homo sapiens
  misc_feature (0)...(0): Polypeptide Accession Number Q06889
MTGKLAEKLPVTMSSLLNQLPDNLYPEEIPSALNLFSGSSDSVVHYNQMATENVMDIGLTNEKPNPELSYSGSFQPAPGNKTVTYLGKFAFDSPSNWCQDNIISLMSAGILGVPPASGALSTQTSTASMVQPPQGDVEAMYPALPPYSNCGDLYSEPVSFHDPQGNPGLAYSPQDYQSAKPALDSNLFPMIPDYNLYHHPNDMGSIPEHKPFQGMDPIRVNPPPITPLETIKAFKDKQIHPGFGSLPQPPLTLKPIRPRKYPNRPSKTPLHERPHACPAEGCDRRFSRSDELTRHLRIHTGHKPFQCRICMRSFSRSDHLTTHIRTHTGEKPFACEFCGRKFARSDERKRHAKIHLKQKEKKAEKGGAPSASSAPPVSLAPVVTTCA

SEQ ID NO: 1279 - protein, 474 aa, Homo sapiens
  misc_feature (0)...(0): Polypeptide Accession Number Q06945
MVQQTNNAENTEALLAGESSDSGAGLELGIASSPTPGSTASTGGKADDPSWCKTPSGHIKRPMNAFMVWSQIERRKIMEQSPDMHNAEISKRLGKRWKLLKDSDKIPFIREAERLRLKHMADYPDYKYRPRKKVKSGNANSSSSAAASSKPGEKGDKVGGSGGGGHGGGGGGGSSNAGGGGGGASGGGANSKPAQKKSCGSKVAGGAGGGVSKPHAKLILAGGGGGGKAAAAAAASFAAEQAGAAALLPLGAAADHHSLYKARTPSASASASSAASASAALAAPGKHLAEKKVKRVYLFGGLGTSSSPVGGVGAGADPSDPLGLYEEEGAGCSPDAPSLSGRSSAASSPAAGRSPADHRGYASLRAASPAPSSAPSHASSSASSHSSSSSSSGSSSSDDEFEDDLLDLNPSSNFESMSLGSFSSSSALDRDLDFNFEPGSGSHFEFPDYCTPEVSEMISGDWLESSISNLVFTY

SEQ ID NO: 1280 - protein, 1898 aa, Homo sapiens
  misc_feature (0)...(0): Polypeptide Accession Number Q07283
MSPLLRSICDITEIFNQYVSHDCDGAALTKKDLKNLLEREFGAVLRRPHDPKTVDLILELLDRDSNGRVDFNEFLLFIFKVAQACYYALGQATGLDEEKRARCDGKESLLQDRRTEEDQRRFEPRDRQLEEEPGQRRRQKRQEQERELAEGEEQSEKQERLEQRDRQRRDEELWRQRQEWQEREERRAEEEQLQSCKGHETEEFPDEEQLRRRELLELRRKGREEKQQQRRERQDRVFQEEEEKEWRKRETVLRKEEEKLQEEEPQRQRELQEEEEQLRKLERQELRRERQEEEQQQQRLRREQQLRRKQEEERREQQEERREQQERREQQEERREQQLRREQEERREQQLRREQEEERREQQLRREQEEERREQQLRREQEEERREQQLRREQQLRREQQLRREQQLRREQQLRREQQLRREQQLRREQQLRREQQLRREQQLRREQEEERHEQKHEQERREQRLKREQEERRDWLKREEETERHEQERRKQQLKRDQEEERRERWLKLEEEERREQQERREQQLRREQEERREQRLKRQEEEERLQQRLRSEQQLRREQEERLEQLLKREEEKRLEQERREQRLKREQEERRDQLLKREEERRQQRLKREQEERLEQRLKREEVERLEQEERRDERLKREEPEEERRHELLKSEEQEERRHEQLRREQQERREQRLKREEEEERLEQRLKREHEEERREQELAEEEQEQARERIKSRIPKWQWQLESEADARQSKVLLEAPQAGRAEAPQEQEEKRRRESELQWQEEERAHRQQQEEEQRRDFTWQWQAEEKSERGRQRLSARPPLREQRERQLRAEERQQREQRFLPEEEEKEQRGRQRREREKELQFLEEEEQLQRRERAQQLQEEEDGLQEDQERRRQEQRRDQKWRWQLEEERKRRRHTLYAKPALQEQLRKEQQLLQEEEEELQREEREKRRRQEQERQYREEEQLQQEEEQLLREEREKRRRQERERQYRKDKKLQQKEEQLLGEEPEKRRRQEREKKYREEEELQQEEEQLLREEREKRRRQEWERQYRKKDELQQEEEQLLREEREKRRLQERERQYREEEELQQEEEQLLGEERETRRRQELERQYRKEEELQQEEEQLLREEPEKRRRQERERQCREEEELQQEEEQLLREEREKRRRQELERQYREEEELQRQKRKQRYRDEDQRSDLKWQWEPEKENAVRDNKVYCKGRENEQFRQLEDSQVRDRQSQQDLQHLLGEQQERDREQERRRWQQANRHFPEEEQLEREEQKEAKRRDRKSQEEKQLLREEREEKRRRQETDRKFREEEQLLQEREEQPLLRQERDRKFREEELLHQEQGRKFLEEEQRLREERERKFLKEEQQLRLEEREQLRQDRDRKFREEEQQLSRQERDRKFREEEQQVRRQERERKFLEEEQQLRQERHRKFREEEQLLQEREEQQLHRQERDRKFLEEEQQLRRQERDRKFREQELRSQEPERKFLEEEQQLHRQQRQRKFLQEEQQLRRQERGQQRRQDRDRKFREEEQLRQEREEQQLSRQERDRKFRLEEQKVRRQEQERKFMEDEQQLRRQEGQQQLRQEDRKFREDEQLLQEREEQQLHRQERDRKFLEEEPQLRRQEREQQLRHDRDRKFREEEQLLQEGEEQQLRRQERDRKFREEEQQLRRQERERKFLQEEQQLRRQELERKFREEEQLRQETEQEQLRRQERYRKILEEEQLRPEREEQQLRRQERDRKFREEEQLRQGREEQQLRSQESDRKFREEEQLRQEREEQQLRPQQRDGKYRWEEEQLQLEEQEQRLRQERDRQYRAEEQFATQEKSRREEQELWQEEEQKRRQERERKLREEHIRRQQKEEQRHRQVGEIQSQEGKGHGRLLEPGTHQFASVPVRSSPLYEYIQEQRSQYRP

SEQ ID NO: 1281 - protein, 338 aa, Homo sapiens
  misc_feature (0)...(0): Polypeptide Accession Number Q07352
MTTTLVSATIFDLSEVLCKGNKMLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELCRPFEENGACKYGDKCQFAHGIHELRSLTRHPKYKTELCRTFHTIGFCPYGPRCHFIHNAEERRALAGARDLSADRPRLQHSFSFAGFPSAAATAAATGLLDSPTSITPPPILSADDLLGSPTLPDGTNNPFAFSSQELASLFAPSMGLPGGGSPTTFLFRPMSESPHMFDSPPSPQDSLSDQEGYLSSSSSSHSGSDSPTLDNSRRLPIFSRLSISDD

SEQ ID NO: 1282 - protein, 494 aa, Homo sapiens
  misc_feature (0)...(0): Polypeptide Accession Number Q08170
MPRVYIGRLSYQARERDVERFFKGYGKILEVDLKNGYGFVEFDDLRDADDAVYELNGKDLCGERVIVEHARGPRRDGSYGSGRSGYGYRRSGRDKYGPPTRTEYRLIVENLSSRCSWQDLKDYMRQAGEVTYADAHKGRKNEGVIEFVSYSDMKRALEKLDGTEVNGRKIRLVEDKPGSRRRRSYSRSRSHSRSRSRSRHSRKSRSRSGSSKSSHSKSRSRSRSGSRSRSKSRSRSQSRSRSKKEKSRSPSKDKSRSRSHSAGKSRSKSKDQAEEKIQNNDNVGKPKSRSPSRHKSKSKSRSRSQERRVEEEKRGSVEQGQEQEKSLRQSRSRSRSKAGSRSRSRSRSKSKDKRKSRKRSREESRSRSRSRSKSERSRKRGSKRDSKAGSSKKKKKEDTDRSQSRSPSRSVSKEREHAKSESSQREGRGESENAGRNEETRSRSRSNSKSKPNLPSESRSRSKSASKTRSRSKSRSRSASRSPSRSRSRSHSRS

SEQ ID NO: 1283 - protein, 521 aa, Homo sapiens
  misc_feature (0)...(0): Polypeptide Accession Number Q08209
MSEPKAIDPKLSTTDRVVKAVPFPPSHRLTAKEVFDNDGKPRVDILKAHLMKEGRLEESVALRIITEGASILRQEKNLLDIDAPVTVCGDIHGQFFDLMKLFEVGGSPANTRYLFLGDYVDRGYFSIECVLYLWALKILYPKTLFLLRGNHECRHLTEYFTFKQECKIKYSERVYDACMDAFDCLPLAALMNQQFLCVHGGLSPEINTLDDIRKLDRFKEPPAYGPMCDILWSDPLEDFGNEKTQEHFTHNTVRGCSYFYSYPAVCEFLQHNNLLSILRAHEAQDAGYRMYRKSQTTGFPSLITIFSAPNYLDVYNNKAAVLKYENNVMNIRQFNCSPHPYWLPNFMDVFTWSLPFVGEKVTEMLVNVLNICSDDELGSEEDGFDGATAAARKEVIRNKIRAIGKMARVFSVLREESESVLTLKGLTPTGMLPSGVLSGGKQTLQSATVEAIEADEAIKGFSPQHKITSFEEAKGLDRINERMPPRRDAMPSDANLNSINKALTSETNGTDSNGSNSSNIQ

SEQ ID NO: 1284 - protein, 579 aa, Homo sapiens
  misc_feature (0)...(0): Polypeptide Accession Number Q08378
EQGRFRTGDSAALQAVKSGKEELDRGARRLEEGTEETSETLEKLREELAIKSGQVEHLQQETAALKKQMQKIKEQFLQQKVMVEAYRRDATSKDQLISELKATRKRLDSELKELRQELMQVHGEKRTAEAELSRLHREVAQVRQHMADLEGHLQSAQKERDEMETHLQSLQFDKEQMVAVTEANEALKKQIEELQQEARKAITEQKQKMRRLGSDLTSAQKEMKTKHKAYENAVGILSRRLQEALAAKEAADAELGQLRAQGGSSDSSLALHERIQALEAELQAVSHSKTLLEKELQEVIALTSQELEESREKVLELEDELQESRGFRKKIKRLEESNKKLALELEHEKGKLTGLGQSNAALREHNSILETALAKREADLVQLNLQVQAVLQRKEEEDRQMKHLVQALQASLEKEKEKVNSLKEQVAAAKVEAGHNRRHFKAASLELSEVKKELQAKEHLVQKLQAEADDLQIREGKHSQEIAQFQAELAEARAQLQLLQKQLDEQLSKQPVGNQEMENLKWEVDQKEREIQSLKQQLDLTEQQGRKELEGLQQLLQNVKSELEMAQEDLSMTQKDKFM

SEQ ID NO: 1285 - protein, 620 aa, Homo sapiens
  misc_feature (0)...(0): Polypeptide Accession Number Q08379
MESVRQLQMERDKYAENLKGESAMWRQRMQQMSEQVHTLREEKECSMSRVQELETSLAELRNQMAEPPPPEPPAGPSEVEQQLQAEAEHLRKELEGLAGQLQAQVQDNEGLSRLNREQEERLLELERAAELWGEQAEARRQILETMQNDRTTISRALSQNRELKEQLAELQSGFVKLTNENMEITSALQSEQHVKRELGKKLGELQEKLSELKETVELKSQEAQSLQQQRDQYLGHLQQYVAAYQQLTSEKEVLHNQLLLQTQLVDQLQQQEAQGKAVAEMARQELQETQERLEAATQQNQQLRAQLSLMAHPGEGDGLDREEEEDEEEEEEEAVAVPQPMPSIPEDLESREAMVAFFNSAVASAEEEQARLRGQLKEQRVRCRRLAHLLASAQKEPEAAAPAPGTGGDSVCGETHRALQGAMEKLQSRFMELMQEKADLKERVEELEHRCIQLSGETDTIGEYIALYQSQRAVLKERHREKEEYISRLAQDKEEMKVKLLELQELVLRLVGDRNEWHGRFLAAAQNPADEPTSGAPAPQELGAANQQGDLCEVSLAGSVEPAQGEAREGSPRDNPTAQQIMQLLREMQNPRERPGLGSNPCIPFFYRADENDEVKITVI

SEQ ID NO: 1286 - protein, 370 aa, Homo sapiens
  misc_feature (0)...(0): Polypeptide Accession Number Q08752
MSHPSPQAKPSNPSNPRVFFDVDIGGERVGRIVLELFADIVPKTAENFRALCTGEKGIGHTTGKPLHFKGCPFHRIIKKFMIQGGDFSNQNGTGGESIYGEKFEDENFHYKHDREGLLSMANAGRNTNGSQFFITTVPTPHLDGKHVVFGQVIKGIGVARILENVEVKGEKPAKLCVIAECGELKEGDDGGIFPKDGSGDSHPDFPEDADIDLKDVDKILLITEDLKNIGNTFFKSQNWEMAIKKYAEVLRYVDSSKAVIETADRAKLQPIALSCVLNIGACKLKMSNWQGAIDSCLEALELDPSNTKALYRRAQGWQGLKEYDQALADLKKAQGIAPEDKAIQAELLKVKQKIKAQKDKEKAVYAKMFA

SEQ ID NO: 1287 - protein, 709 aa, Homo sapiens
  misc_feature (0)...(0): Polypeptide Accession Number Q08945
MAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 1288 - protein, 425 aa, Homo sapiens
  misc_feature (0)...(0): Polypeptide Accession Number Q09028
MADKEAAFDDAVEERVINEEYKIWKKNTPFLYDLVMTHALEWPSLTAQWLPDVTRPEGKDFSIHRLVLGTHTSDEQNHLVIASVQLPNDDAQFDASHYDSEKGEFGGFGSVSGKIEIEIKINHEGEVNRARYMPQNPCIIATKTPSSDVLVFDYTKHPSKPDPSGECNPDLRLRGHQKEGYGLSWNPNLSGHLLSASDDHTICLWDISAVPKEGKVVDAKTIFTGHTAVVEDVSWHLLHESLFGSVADDQKLMIWDTRSNNTSKPSHSVDAHTAEVNCLSFNPYSEFILATGSADKTVALWDLRNLKLKLHSFESHKDEIFQVQWSPHNETILASSGTDRRLNVWDLSKIGEEQSPEDAEDGPPELLFIHGGHTAKISDFSWNPNEPWVICSVSEDNIMQVWQMAENIYNDEDPEGSVDPEGQGS

SEQ ID NO: 1289 - protein, 2414 aa, Homo sapiens
  misc_feature (0)...(0): Polypeptide Accession Number Q09472
MAENVVEPGPPSAKRPKLSSPALSASASDGTDFGSLFDLEHDLPDELINSTELGLTNGGDINQLQTSLGMVQDAASKHKQLSELLRSGSSPNLNMGVGGPGQVMASQAQQSSPGLGLINSMVKSPMTQAGLTSPNMGMGTSGPNQGPTQSTGMMNSPVNQPAMGMNTGTNAGMNPGMLAAGNGQGIMPNQVMNGSIGAGRGRQDMQYPNPGMGSAGNLLTEPLQQGSPQMGGQTGLRGPQPLKMGMMNNPNPYGSPYTQNPGQQIGASGLGLQIQTKTVLSNNLSPFAMDKKAVPGGGMPNMGQQPAPQVQQPGLVTPVAQGMGSGAHTADPEKRKLIQQQLVLLLHAHKCQRREQANGEVRQCNLPHCRTMKNVLNHMTHCQSGKSCQVAHCASSRQIISHWKNCTRHDCPVCLPLKNAGDKRNQQPILTGAPVGLGNPSSLGVGQQSAPNLSTVSQIDPSSIERAYAALGLPYQVNQMPTQPQVQAKNQQNQQPGQSPQGMRPMSNMSASPMGVNGGVGVQTPSLLSDSMLHSAINSQNPMMSENASVPSLGPMPTAAQPSTTGIRKQWHEDITQDLRNHLVHKLVQAIFPTPDPAALKDRRMENLVAYARKVEGDMYESANNRAEYYHLLAEKIYKIQKELEEKRRTRLQKQNMLPNAAGMVPVSMNPGPNMGQPQPGMTSNGPLPDPSMIRGSVPNQMMPRITPQSGLNQFGQMSMAQPPIVPRQTPPLQHHGQLAQPGALNPPMGYGPRMQQPSNQGQFLPQTQFPSQGMNVTNIPLAPSSGQAPVSQAQMSSSSCPVNSPIMPPGSQGSHIHCPQLPQPALHQNSPSPVPSRTPTPHHTPPSIGAQQPPATTIPAPVPTPPAMPPGPQSQALHPPPRQTPTPPTTQLPQQVQPSLPAAPSADQPQQQPRSQQSTAASVPTPNAPLLPPQPATPLSQPAVSIEGQVSNPPSTSSTEVNSQAIAEKQPSQEVKMEAKMEVDQPEPADTQPEDISESKVEDCKMESTETEERSTELKTEIKEEEDQPSTSATQSSPAPGQSKKKIFKPEELRQALMPTLEALYRQDPESLPFRQPVDPQLLGIPDYFDIVKSPMDLSTIKRKLDTGQYQEPWQYVDDIWLMFNNAWLYNRKTSRVYKYCSKLSEVFEQEIDPVMQSLGYCCGRKLEFSPQTLCCYGKQLCTIPRDATYYSYQNRYHFCEKCFNEIQGESVSLGDDPSQPQTTINKEQFSKRKNDTLDPELFVECTECGRKMHQICVLHHEIIWPAGFVCDGCLKKSARTRKENKFSAKRLPSTRLGTFLENRVNDFLRRQNHPESGEVTVRVVHASDKTVEVKPGMKARFVDSGEMAESFPYRTKALFAFEEIDGVDLCFFGMHVQEYGSDCPPPNQRRVYISYLDSVHFFRPKCLRTAVYHEILIGYLEYVKKLGYTTGHIWACPPSEGDDYIFHCHPPDQKIPKPKRLQEWYKKMLDKAVSERIVHDYKDIFKQATEDRLTSAKELPYFEGDFWPNVLEESIKELEQEEEERKREENTSNESTDVTKGDSKNAKKKNNKKTSKNKSSLSRGNKKKPGMPNVSNDLSQKLYATMEKHKEVFFVIRLIAGPAANSLPPIVDPDPLIPCDLMDGRDAFLTLARDKHLEFSSLRRAQWSTMCMLVELHTQSQDRFVYTCNECKHHVETRWHCTVCEDYDLCITCYNTKNHDHKMEKLGLGLDDESNNQQAAATQSPGDSRRLSIQRCIQSLVHACQCRNANCSLPSCQKMKRVVQHTKGCKRKTNGGCPICKQLIALCCYHAKHCQENKCPVPFCLNIKQKLRQQQLQHRLQQAQMLRRRMASMQRTGVVGQQQGLPSPTPATPTTPTGQQPTTPQTPQPTSQPQPTPPNSMPPYLPRTQAAGPVSQGKAAGQVTPPTPPQTAQPPLPGPPPTAVEMAMQIQRAAETQRQMAHVQIFQRPIQHQMPPMTPMAPMGMNPPPMTRGPSGHLEPGMGPTGMQQQPPWSQGGLPQPQQLQSGMPRPAMMSVAQHGQPLNMAPQPGLGQVGISPLKPGTVSQQALQNLLRTLRSPSSPLQQQQVLSILHANPQLLAAFIKQRAAKYANSNPQPIPGQPGMPQGQPGLQPPTMPGQQGVHSNPAMQNMNPMQAGVQRAGLPQQQPQQQLQPPMGGMSPQAQQMNMNHNTMPSQFRDILRRQQMMQQQQQQGAGPGIGPGMANHNQFQQPQGVGYPPQPQQRMQHHMQQMQQGNMGQIGQLPQALGAEAGASLQAYQQRLLQQQMGSPVQPNPMSPQQHMLPNQAQSPHLQGQQIPNSLSNQVRSPQPVPSPRPQSQPPHSSPSPRMQPQPSPHHVSPQTSSPHPGLVAAQANPMEQGHFASPDQNSMLSQLASNPGMANLHGASATDLGLSTDNSDLNSNLSQSTLDIH

SEQ ID NO: 1290 - protein, 949 aa, Homo sapiens
  misc_feature (0)...(0): Polypeptide Accession Number Q10567
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLMGDEPEGIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTDLELSLKCRAPEVSQHVYQAYETILKN

SEQ ID NO: 1291 - protein, 1319 aa, Homo sapiens
  misc_feature (0)...(0): Polypeptide Accession Number Q10571
MFGLDQFEPQVNSRNAGQGERNFNETGLSMNTHFKAPAFHTGGPPGPVDPAMSALGQPPILGMNMEPYGFHARGHSELHAGGLQAQPVHGFFGGQQPHHGHPGSHHPHQHHPHFGGNFGGPDPGASCLHGGRLLGYGGAAGGLGSQPPFAEGYEHMAESQGPESFGPQRPGNLPDFHSSGASSHRVPAPCLPLDQSPNRAASFHGLPSSSGSDSHSLEPRRVTNQGAVDSLEYNYRARRPRDILTCFRPLTPKGSCLIMQRVARFLGGGFPGAPSAMPRAAGMVGLSKMHAQPPQQQPQQQQQPQQQQQHGVFFERFSGARKMPVGLEPSVGSRHPLMQPPQQAPPPPQQQPPQQPPQQQPPPPPGLLVRQNSLPACAPSAPAGRGGHAQRRPAGRRPHAAQPARAIRVSHPPAGEPEHAPLFRACFQHAASSSAAGAQPAAAAFRRAPLHERGQEARFDFPGSAGVDRCASWNGSMHNGALDNHLSPSAYPGLPGEFTPPVPDSFPSGPPLQHPAPDHQSLQQQQQQQQQQQQQQQQQQQQQQQQQQQQRQNAALMIKQMASRNQQQRLRQPNLAQLGHPGDVGQGGLVHGGPVGGLAQPNFEREGGSTGAGRLGTFEQQAPHLAQESAWFSGPHPPPGDLLPRRMGGSGLPADCGPHDPSLAPPPPPGGSGVLFRGPLQEPMRMPGEATCRAAFTGLQFGGSLGGLGQLQSPGAGVGLPSAASERRPPPPDFATSALGGQPGFPFGAAGRQSTPHSGPGVNSPPSAGGGGGSSGGGGGGGAYPPQPDFQPSQRTSASKLGALSLGSFNKPSSKDNLFGQSCLAALSTACQNMIASLGAPNLNVTFNKKNPPEGKRKLSQNETDGAAVAGNPGSDYFPGGTAPGGPRTRRPSGTSSSGSKASGPPNPPAQGDGTSLSPNYTLESTSGNDGKPVSGGGGRGRGRRKRDSGHVSPGTFFDKYSAAPDSGGAPGVSPGQQQASGAAVGGSSAGETRGAPTPHEKALTSPSWGKGAELLLGDQPDLIGSLDGGAKSDSSSPNVGEFASDEVSTSYANEDEVSSSSDNPQALVKASRSPLVTGSPKLPPRGVGAGEHGPKAPPPALGLGIMSNSTSTPDSYGGGGGPGHPGTPGLEQVRTPTSSSGAPPPDEIHPLEILQAQIQLQRQQFSISEDQPLGLKGGKKGECAVGASGAQNGDSELGSCCSEAVKSAMSTIDLDSLMAEHSAAWYMPADKALVDSADDDKTLAPWEKAKPQNPNSKEAHDLPANKASASQPGSHLQCLSVHCTDDVGDAKARASVPTWRSLHSDISNRFGTFVAALT

SEQ ID NO: 1292 - protein, 519 aa, Homo sapiens
  misc_feature (0)...(0): Polypeptide Accession Number Q12788
MAFDPTSTLLATGGCDGAVRVWDIVRHYGTHHFRGSPGVVHLVAFHPDPTRLLLFSSATDAAIRVWSLQDRSCLAVLTAHYSAVTSLAFSADGHTMLSSGRDKICIIWDLQSCQATRTVPVFESVEAAVLLPEEPVSQLGVKSPGLYFLTAGDQGTLRVWEAASGQCVYTQAQPPGPGQELTHCTLAHTAGVVLTATADHNLLLYEARSLRLQKQFAGYSEEVLDVRFLGPEDSHVVVASNSPCLKVFELQTSACQILHGHTDIVLALDVFRKGWLFASCAKDQSVRIWRMNKAGQVMCVAQGSGHTHSVGTVCCSRLKESFLVTGSQDCTVKLWPLPKALLSKNTAPDNGPILLQAHTTQRCHDKDINSVAIAPNDKLLATGSQDRTAKLWALPQCQLLGVFSGHRVASGASSSLPWTRCWPRPQLMAPSSSGHSRTSAVSRHLRGTMLLCLKVAFVSRGTQLLSSGSDGLVKLWTIKNNECVRTLDAHEDKVWGLQAGWTTTPSLGPVTPESSSGRM

SEQ ID NO: 1293 - protein, 1032 aa, Homo sapiens
  misc_feature (0)...(0): Polypeptide Accession Number Q12840
MAETNNECSIKVLCRFRPLNQAEILRGDKFIPIFQGDDSVVIGGKPYVFDRVFPPNTTQEQVYHACAMQIVKDVLAGYNGTIFAYGQTSSGKTHTMEGKLHDPQLMGIIPRIARDIFNHIYSMDENLEFHIKVSYFEIYLDKIRDLLDVTKTNLSVHEDKNRVPFVKGCTERFVSSPEEILDVIDEGKSNRHVAVTNMNEHSSRSHSIFLINIKQENMETEQKLSGKLYLVDLAGSEKVSKTGAEGAVLDEAKNINKSLSALGNVISALAEGTKSYVPYRDSKMTRILQDSLGGNCRTTMFICCSPSSYNDAETKSTLMFGQRAKTIKNTASVNLELTAEQWKKKYEKEKEKTKAQKETIAKLEAELSRWRNGENVPETERLAGEEAALGAELCEETPVNDNSSIVVRIAPEERQKYEEEIRRLYKQLDDKDDEINQQSQLIEKLKQQMLDQEELLVSTRGDNEKVQRELSHLQSENDAAKDEVKEVLQALEELAVNYDQKSQEVEEKSQQNQLLVDELSQKVATMLSLESELQRLQEVSGHQRKRIAEVLNGLMKDLSEFSVIVGNGEIKLPVEISGAIEEEFTVARLYISKIKSEVKSVVKRCRQLENLQVECHRKMEVTGRELSSCQLLISQHEAKIRSLTEYMQSVELKKRHLEESYDSLSDELAKLQAQETVHEVALKDKEPDTQDADEVKKALELQMESHREAHHRQLARLRDEINEKQKTIDELKDLNQKLQLELEKLQADYEKLKSEEHEKSTKLQELTFLYERHEQSKQDLKGLEETVARELQTLHNLRKLFVQDVTTRVKKSAEMEPEDSGGIHSQKQKISFLENNLEQLTKVHKQLVRDNADLRCELPKLEKRLRATAERVKALEGALKEAKEGAMKDKRRYQQEVDRIKEAVRYKSSGKRAHSAQIAKPVRPGHYPASSPTNPYGTRSPECISYTNSLFQNYQNLYLQATPSSTSDMYFANSCTSSGATSSGGPLASYQKANMDNGNATDINDNRSDLPCGYEAEDQAKLFPLHQETAAS

SEQ ID NO: 1294 - protein, 218 aa, Homo sapiens
  misc_feature (0)...(0): Polypeptide Accession Number Q12962
MSCSGSGADPEAAPASAASAPGPAPPVSAPAALPSSTAAENKASPAGTAGGPGAGAAAGGTGPLAARAGEPAERRGAAPVSAGGAAPPEGAISNGVYVLPSAANGDVKPVVSSTPLVDFLMQLEDYTPTIPDAVTGYYLNRAGFEASDPRIIRLISLAAQKFISDIANDALQHCKMKGTASGSSRSKSKDRKYTLTMEDLTPALSEYGINVKKPHYFT

SEQ ID NO: 1295 - protein, 471 aa, Homo sapiens
  misc_feature (0)...(0): Polypeptide Accession Number Q13098
MQIDVDPQEDPQNAPDVNYVVENPSLDLEQYAASYSGLMRIERQLFIADHCPTLRVEALKMALSFVQRTFNVDMYEEIHRKLSEATRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVLSYVSKAESTPEIAEQRGERDSQTQAILTKLKCAAGLAELAARKYKQAAKCLLLASFDHCDFPELLSPSNVAIYGGLCALATFDRQELQRNVISSSSFKLFLELEPQVRDIIFKFYESKYASCLKMLDEMKDNLLLDMYLAPHVRTLYTQIRNRALIQYFSPYVSADMHRMAAAFNTTVAALEDELTQLILEGLISARVDSHSKILYARDVDQRSTTFEKSLLMGKEFQRRAKAMMLRAAVLRNQIHVKSPPREGSQGELTPANSQSRMSTNM

SEQ ID NO: 1296 - protein, 174 aa, Homo sapiens
  misc_feature (0)...(0): Polypeptide Accession Number Q13131
GAFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRLYVGPEVDLW

SEQ ID NO: 1297 - protein, 545 aa, Homo sapiens
  misc_feature (0)...(0): Polypeptide Accession Number Q13153
MSNNGLDIQDKPPAPPMRNTSTMIGVGSKDAGTLNHGSKPLPPNPEEKKKKDRFYRSILPGDKTNKKKEKERPEISLPSDFEHTIHVGFDAVTGEFTGMPEQWARLLQTSNITKSEQKKNPQAVLDVLEFYNSKKTSNSQKYMSFTDKSAEDYNSSNALNVKAVSETPAVPPVSEDEDDDDDDATPPPVIAPRPEHTKSVYTRSVIEPLPVTPTRDVATSPISPTENNTTPPDALTRNTEKQKKKPKMSDEEILEKLRSIVSVGDPKKKYTRFEKIGQGASGTVYTAMDVATGQEVAIKQMNLQQQPKKELIINEILVMRENKNPNIVNYLDSYLVGDELWVVMEYLAGGSLTDVVTETCMDEGQIAAVCRECLQALEFLHSNQVIHRDIKSDNILLGMDGSVKLTDFGFCAQITPEQSKRSTMVGTPYWMAPEVVTRKAYGPKVDIWSLGIMAIEMIEGEPPYLNENPLRALYLIATNGTPELQNPEKLSAIFRDFLNRCLDMDVEKRGSAKELLQHQFLKIAKPLSSLTPLIAAAKEATKNNH

SEQ ID NO: 1298 - protein, 271 aa, Homo sapiens
  misc_feature (0)...(0): Polypeptide Accession Number Q13162
MEALPLLAATTPDHGRHRRLLLLPLLLFLLPAGAVQGWETEERPRTREEECHFYAGGQVYPGEASRVSVADHSLHLSKAKISKPAPYWEGTAVIDGEFKELKLTDYRGKYLVFFFYPLDFTFVCPTEIIAFGDRLEEFRSINTEVVACSVDSQFTHLAWINTPRRQGGLGPIRIPLLSDLTHQISKDYGVYLEDSGHTLRGLFIIDDKGILRQITLNDLPVGRSVDETLRLVQAFQYTDKHGEVCPAGWKPGSETIIPDPAGKLKYFDKLN

SEQ ID NO: 1299 - protein, 438 aa, Homo sapiens
  misc_feature (0)...(0): Polypeptide Accession Number Q13163
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMEIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 1300 - protein, 815 aa, Homo sapiens
  misc_feature (0)...(0): Polypeptide Accession Number Q13164
MAEPLKEEDGEDGSAEPPAREGRTRPHRCLCSAKNLALLKARSFDVTFDVGDEYEIIETIGNGAYGVVSSARRRLTGQQVAIKKIPNAFDVVTNAKRTLRELKILKHFKHDNIIAIKDILRPTVPYGEFKSVYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPLAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 1301 - protein, 524 aa, Homo sapiens
  misc_feature (0)...(0): Polypeptide Accession Number Q13177
MSDNGELEDKPPAPPVRMSSTIFSTGGKDPLSANHSLKPLPSVPEEKKPRHKIISIFSGTEKGSKKKEKERPEISPPSDFEHTIHVGFDAVTGEFTGMPEQWARLLQTSNITKLEQKKNPQAVLDVLKFYDSNTVKQKYLSFTPPEKDGLPSGTPALNAKGTEAPAVVTEEEDDDEETAPPVIAPRPDHTKSIYTRSVIDPVPAPVGDSHVDGAAKSLDKQKKKPKMTDEEIMEKLRTIVSIGDPKKKYTRYEKIGQGASGTVFTATDVALGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMVEGEPPYLNENPLRALYLIATNGTPELQNPEKLSPIFRDFLNRCLEMDVEKRGSAKELLQHPFLKLAKPLSSLTPLIMAAKEAMKSNR

SEQ ID NO: 1302 - protein, 301 aa, Homo sapiens
  misc_feature (0)...(0): Polypeptide Accession Number Q13190
MSCRDRTQEFLSACKSLQTRQNGIQTNKPALRAVRQRSEFTLMAKRIGKDLSNTFAKLEKLTILAKRKSLFDDKAVEIEELTYIIKQDINSLNKQIAQLQDFVRAKGSQSGRHLQTHSNTIVVSLQSKLASMSNDFKSVLEVRTENLKQQRSRREQFSRAPVSALPLAPNHLGGGAVVLGAESHASKDVAIDMMDSRTSQQLQLIDEQDSYIQSRADTMQNIESTIVELGSIFQQLAHMVKEQEETIQRIDENVLGAQLDVEAAHSEILKYFQSVTSNRWLMVKIFLILIVFFIIFVVFLA

SEQ ID NO: 1303 - protein, 396 aa, Homo sapiens
  misc_feature (0)...(0): Polypeptide Accession Number Q13216
MLGFLSARQTGLEDPLRLRRAESTRRVLGLELNKDRDVERIHGGGINTLDIEPVEGRYMLSGGSDGVIVLYDLENSSRQSYYTCKAVCSIGRDHPDVHRYSVETVQWYPHDTGMFTSSSFDKTLKVWDTNTLQTADVFNFEETVYSHHMSPVSTKHCLVAVGTRGPKVQLCDLKSGSCSHILQGHRQEILAVSWSPRYDYILATASADSRVKLWDVRRASGCLITLDQHNGKKSQAVESANTAHNGKVNGLCFTSDGLHLLTVGTDNRMRLWNSSNGENTLVNYGKVCNNSKKGLKFTVSCGCSSEFVFVPYGSTIAVYTVYSGEQITMLKGHYKTVDCCVFQSNFQELYSGSRDCNILAWVPSLYEPVPDDDETTTKSQLNPAFEDAWSSSDEEG

SEQ ID NO: 1304 - protein, 321 aa, Homo sapiens
  misc_feature (0)...(0): Polypeptide Accession Number Q13360
MAAGWLTTWSQNSVTFQEVAVDFSQEEWALLDPAQKNLYKDVMLENFRNLASVGYQLCRHSLISKVDQEQLKTDERGILQGDCADWETQLKPKDTIAMQNIPGGKTSNGINMNCVRTHSGEMPYECSDCGKAFIFQSSLKKHMRSHTGEKPYECDHCGKSFSQSSHLNVHKRTHTGEKPYDCKECGKAFTVPSSLQKHVRTHTGEKPYECSDCGKAFIDQSSLKKHTRSHTGEKPYECNQCGKSFSTGSYLIVHKRTHTGEKTYECKECGKAFRNSSCLRVHVRTHTGEKPYKCFQCEKAFSTSTNLIMHKRIHNGQKLHE

SEQ ID NO: 1305 - protein, 440 aa, Homo sapiens
  misc_feature (0)...(0): Polypeptide Accession Number Q13363
MGSSHLLNKGLPLGVRPPIMNGPLHPRPLVALLDGRDCTVEMPILKDVATVAFCDAQSTQEIHEKVLNEAVGALMYHTITLTREDLEKFKALRIIVRIGSGFDNIDIKSAGDLGIAVCNVPAASVEETADSTLCHILNLYRRATWLHQALREGTRVQSVEQIREVASGAARIRGETLGIIGLGRVGQAVALRAKAFGFNVLFYDPYLSDGVERALGLQRVSTLQDLLFHSDCVTLHCGLNEHNHHLINDFTVKQMRQGAFLVNTARGGLVDEKALAQALKEGRIRGAALDVHESEPFSFSQGPLKDAPNLICTPHAAWYSEQASIEMREEAAREIRRAITGRIPDSLKNCVNKDHLTAATHWASMDPAVVHPELNGAAYRYPPGVVGVAPTGIPAAVEGIVPSAMSLSHGLPPVAHPPHAPSPGQTVKPEADRDHASDQL

SEQ ID NO: 1306 - protein, 577 aa, Homo sapiens
  misc_feature (0)...(0): Polypeptide Accession Number Q13416
MSKPELKEDKMLEVHFVGDDDVLNHILDREGGAKLKKERAQLLVNPKKIIKKPEYDLEEDDQEVLKDQNYVEIMGRDVQESLKNGSATGGGNKVYSFQNRKHSEKMAKLASELAKTPQKSVSFSLKNDPEITINVPQSSKGHSASDKVQPKNNDKSEFLSTAPRSLRKRLIVPRSHSDSESEYSASNSEDDEGVAQEHEEDTNAVIFSQKIQAQNRVVSAPVGKETPSKRMKRDKTSDLVEEYFEAHSSSKVLTSDRTLQKLKRAKLDQQTLRNLLSKVSPSFSAELKQLNQQYEKLFHKWMLQLHLGFNIVLYGLGSKRDLLERFRTTMLQDSIHVVINGFFPGISVKSVLNSITEEVLDHMGTFRSILDQLDWIVNKFKEDSSLELFLLIHNLDSQMLRGEKSQQIIGQLSSLHNIYLIASIDHLNAPLMWDHAKQSLFNWLWYETTTYSPYTEETSYENSLLVKQSGSLPLSSLTHVLRSLTPNARGIFRLLIKYQLDNQDNPSYIGLSFQDFYQQCREAFLVNSDLTLRAQLTEFRDHKLIRTKKGTDGVEYLLIPVDNGTLTDFLEKEEEEA

SEQ ID NO: 1307 - protein, 667 aa, Homo sapiens
  misc_feature (0)...(0): Polypeptide Accession Number Q13438
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 1308 - protein, 482 aa, Homo sapiens
  misc_feature (0)...(0): Polypeptide Accession Number Q13547
MAQTQGTRRKVCYYYDGDVGNYYYGQGHPMKPHRIRMTHNLLLNYGLYRKMEIYRPHKANAEEMTKYHSDDYIKFLRSIRPDNMSEYSKQMQRFNVGEDCPVFDGLFEFCQLSTGGSVASAVKLNKQQTDIAVNWAGGLHHAKKSEASGFCYVNDIVLAILELLKYHQRVLYIDIDIHHGDGVEEAFYTTDRVMTVSFHKYGEYFPGTGDLRDIGAGKGKYYAVNYPLRDGIDDESYEAIFKPVMSKVMEMFQPSAVVLQCGSDSLSGDRLGCFNLTIKGHAKCVEFVKSFNLPMLMLGGGGYTIRNVARCWTYETAVALDTEIPNELPYNDYFEYFGPDFKLHISPSNMTNQNTNEYLEKIKQRLFENLRMLPHAPGVQMQAIPEDAIPEESGDEDEDDPDKRISICSSDKRIACEEEFSDSEEEGEGGRKNSSNFKKAKRVKTEDEKEKDPEEKKEVTEEEKTKEEKPEAKGVKEEVKLA

SEQ ID NO: 1309 - protein, 536 aa, Homo sapiens
  misc_feature (0)...(0): Polypeptide Accession Number Q13573
MALTSFLPAPTQLSQDQLEAEEKARSQRSRQTSLVSSRREPPPYGYRKGWIPRLLEDFGDGGAFPEIHVAQYPLDMGRKKKMSNALAIQVDSEGKIKYDAIARQGQSKDKVIYSKYTDLVPKEVMNADDPDLQRPDEEAIKEITEKTRVALEKSVSQKVAAAMPVRAADKLAPAQYIRYTPSQQGVAFNSGAKQRVIRMVEMQKDPMEPPRFKINKKIPRGPPSPPAPVMHSPSRKMTVKEQQEWKIPPCISNWKNAKGYTIPLDKRLAADGRGLQTVHINENFAKLAEALYIADRKAREAVEMRAQVERKMAQKEKEKHEEKLREMAQKARERRAGIKTHVEKEDGEARERDEIRHDRRKERQHDRNLSRAAPDKRSKLQRNENRDISEVIALGVPNPRTSNEVQYDQRLFNQSKGMDSGFAGGEDEIYNVYDQAWRGGKDMAQSIYRPSKNLDKDMYGDDLEARIKTNRFVPDKEFSGSDRRQRGREGPVQFEEDPFGLDKFLEEAKQHGGSKRPSDSSRPKEHEHEGKKRRKE

SEQ ID NO: 1310 - protein, 980 aa, Homo sapiens
  misc_feature (0)...(0): Polypeptide Accession Number Q13608
MALAVLRVLEPFPTETPPLAVLLPPGGPWPAAELGLVLALRPAGESPAGPALLVAALEGPDAGTEEQGPGPPQLLVSRALLRLLALGSGAWVRARAVRRPPALGWALLGTSLGPGLGPRVGPLLVRRGETLPVPGPRVLETRPALQGLLGPGTRLAVTELRGRARLCPESGDSSRPPPPPVVSSFAVSGTVRRLQGVLGGTGDSLGVSRSCLRGLGLFQGEWVWVAQARESSNTSQPHLARVQVLEPRWDLSDRLGPGSGPLGEPLADGLALVPATLAFNLGCDPLEMGELRIQRYLEGSIAPEDKGSCSLLPGPPFARELHIEIVSSPHYSTNGNYDGVLYRHFQIPRVVQEGDVLCVPTIGQVEILEGSPEKLPRWREMFFKVKKTVGEAPDGPASAYLADTTHTSLYMVGSTLSPVPWLPSEESTLWSSLSPPGLEALVSELCAVLKPRLQPGGALLTGTSSVLLRGPPGCGKTTVVAAACSHLGLHLLKVPCSSLCAESSGAVETKLQAIFSRARRCRPAVLLLTAVDLLGRDRDGLGEDARVMAVLRHLLLNEDPLNSCPPLMVVATTSRAQDLPADVQTAFPHELEVPALSEGQRLSILRALTAHLPLGQEVNLAQLARRCAGFVVGDLYALLTHSSRAACTRIKNSGLAGGLTEEDEGELCAAGFPLLAEDFGQALEQLQTAHSQAVGAPKIPSVSWHDVGGLQEVKKEILETIQLPLEHPELLSLGLRRSGLLLHGPPGTGKTLLAKAVATECSLTFLSVKGPELINMYVGQSEENVREVFARARAAAPCIIFFDELDSLAPSRGRSGDSGGVMDRVVSQLLAELDGLHSTQDVFVIGATNRPDLLDPALLRPGRFDKLVFVGANEDRASQLRVLSAITRKFKLEPSVSLVNVLDCCPPQLTGADLYSLCSDAMTAALKRRVHDLEEGLEPGSSALMLTMEDLLQAAARLQPSVSEQELLRYKRIQRKFAAC

SEQ ID NO: 1311 - protein, 501 aa, Homo sapiens
  misc_feature (0)...(0): Polypeptide Accession Number Q13610
MNRSRQVTCVAWVRCGVAKETPDKVELSKEEVKRLIAEAKEKLQEEGGGSDEEETGSPSEDGMQSARTQARPREPLEDGDPEDDRTLDDDELAEYDLDKYDEEGDPDAETLGESLLGLTVYGSNDQDPYVTLKDTEQYEREDFLIKPSDNLIVCGRAEQDQCNLEVHVYNQEEDSFYVHHDILLSAYPLSVEWLNFDPSPDDSTGNYIAVGNMTPVIEVWDLDIVDSLEPVFTLGSKLSKKKKKKGKKSSSAEGHTDAVLDLSWNKLIRNVLASASADNTVILWDMSLGKPAASLAVHTDKVQTLQFHPFEAQTLISGSYDKSVALYDCRSPDESHRMWRFSGQIERVTWNHFSPCHFLASTDDGFVYNLDARSDKPIFTLNAHNDEISGLDLSSQIKGCLVTASADKYVKIWDILGDRPSLVHSRDMKMGVLFCSSCCPDLPFIYAFGGQKEGLRVWDISTVSSVNEAFGRRERLVLGSARNSSISGPFGSRSSDTPMES

SEQ ID NO: 1312 - protein, 2472 aa, Homo sapiens
  misc_feature (0)...(0): Polypeptide Accession Number Q13813
MDPSGVKVLETAEDIQERRQQVLDRYHRFKELSTLRRQKLEDSYRFQFFQRDAEELEKWIQEKLQIASDENYKDPTNLQGKLQKHQAFEAEVQANSGAIVKLDETGNLMISEGHFASETIRTRLMELHRQWELLLEKMREKGIKLLQAQNLVQYLRECEDVMDWINDKEAIVTSEELGQDLEHVEVLQKKFEEFQTDMAAHEERVNEVNQFAAKLIQEQHPEEELIKTKQDEVNAAWQRLKGLALQRQGKLFGAAEVQRFNRDVDETISWIKEKEQLMASDDFGRDLASVQALLRKHEGLERDLAALEDKVKALCAEADRLQQSHPLSATQIQVKREELITNWEQIRTLAAERHARLNDSYRLQRFLADFRDLTSWVTEMKALINADELASDVAGAEALLDRHQEHKGEIDAHEDSFKSADESGQALLAAGHYASDEVREKLTVLSEERAALLELWELRRQQYEQCMDLQLFYRDTEQVDNWMSKQEAFLLNEDLGDFLDSVEALLKKHEDFEKSLSAQEEKITALDEFATKLIQNNHYAMEDVATRRDALLSRRNALHERAMRRRAQLADSFHLQQFFRDSDELKSWVNEKMKTATDEAYKDPSNLQGKVQKHQAFEAELSANQSRIDALEKAGQKLIDVNHYAKDEVAARMNEVISLWKKLLEATELKGIKLREANQQQQFNRNVEDIELWLYEVEGHLASDDYGKDLTNVQNLQKKHALLEADVAAHQDRIDGVTIQARQFQDAGHFDAENIKKKQEALVARYEALKEPMVARKQKLADSLRLQQLFRDVEDEETWIREKEPIAASTNRGKDLIGVQNLLKKHQALQAEIAGHEPRIKAVTQKGNAMVEEGHFAAEDVKAKLHELNQKWEALKAKASQRRQDLEDSLQAQQYFADANEAESWMREKEPIVGSTDYGKDEDSAEALLKKHEALMSDLSAYGSSIQALREQAQSCRQQVAPTDDETGKELVLALYDYQEKSPREVTMKKGDILTLLNSTNKDWWKVEVNDRQGFVPAAYVKKLDPAQSASRENLLEEQGSIALRQEQIDNQTRITKEAGSVSLRMKQVEELYHSLLELGEKRKGMLEKSCKKFMLFREANELQQWINEKEAALTSEEVGADLEQVEVLQKKFDDFQKDLKANESRLKDINKVAEDLESEGLMAEEVQAVQQQEVYGMMPRDETDSKTASPWKSARLMVHTVATFNSIKELNERWRSLQQLAEERSQLLGSAHEVQRFHRDADETKEWIEEKNQALNTDNYGHDLASVQALQRKHEGFERDLAALGDKVNSLGETAERLTQSHPESAEDLQEKCTELNQAWSSLGKRADQRKAKLGDSHDLQRFLSDFRDLMSWINGIRGLVSSDELAKDVTGAEALLERHQEHRTEIDARAGTFQAFEQFGQQLLAHGHYASPEIKQKLDILDQERADLEKAWVQRRMMLDQCLELQLFHRDCEQAENWMAAREAFLNTEDKGDSLDSVEALIKKHEDFDKAINVQEEKIAALQAFADQLIAAGHYAKGDISSRRNEVLDRWRRLKAQMIEKRSKLGESQTLQQFSRDVDEIEAWISEKLQTASDESYKDPTNIQSKHQKHQAFEAELHANADRIRGVIDMGNSLIERGACAGNEDAVKARLAALADQWQFLVQKSAEKSQKLKEANKQQNFNTGIKDIAFWLSEVEALLASEDYGKDLASVNNLLKKHQLLEADISAHEDRLKDLNSQADSLMTSSAFDTSQVKDKRDTINGRFQKIKSMAASRRAKLNESHRLHQFFRDMDDEESWIKEKKLLVGSEDYGRDLTGVQNLRKKHKRLEAELAAHEPAIQGVLDTGKKLSDDNTIGKEEIQQRLAQFVEHWKELKQLAAARGQRLEESLEYQQFVANVEEEEAWINEKMTLVASEDYGDTLAAIQGLLKKHEAFETAFTVHKDRVNDVCTNGQDLIKKNNHHEENISSKMKGLNGKVSDLEKAAAQRKANVDENSAFLQFNWKADVVESWIGEKENSLKTDDYGRDLSSVQTLLTKQETFDAGLQAFQQEGIANITALKDQLLAAKHVQSKAIEARHASLMKRWSQLLANSAARKKKLLEAQSHFRKVEDLFLTFAKKASAFNSWFENAEEDLTDPVRCNSLEEIKALREAHDAFRSSLSSAQADFNQLAELDRQIKSFRVASNPYTWFTMEALEETWRNLQKIIKERELELQKEQRRQEENDKLRQEFAQHANAFHQWIQETRTYLLDGSCMVEESGTLESQLEATKRKHQEIRAMRSQLKKIEDLGAAMEEALILDNKYTEHSTVGLAQQWDQLDQLGMRMQHNLEQQIQARNTTGVTEEALKEFSMMFKHFDKDKSGRLNHQDGKSCLRSLGYDLPMVEEGEPDPEFEAILDTVDPNRDGHVSLQEYMAFMISRETENVKSSEEIESAFRALSSEGKPYVTKEELYQNLTREQADYCVSHMKPIVDGKGRELPTAFDYVEFTRSLFVN

SEQ ID NO: 1313 - protein, 428 aa, Homo sapiens
  misc_feature (0)...(0): Polypeptide Accession Number Q13838
MAENDVDNELLDYEDDEVETAAGGDGAEAPAKKDVKGSYVSIHSSGFRDFLLKPELLRAIVDCGFEHPSEVQHECIPQAILGMDVLCQAKSGMGKTAVFVLATLQQLEPVTGQVSVLVMCHTRELAFQISKEYERFSKYMPNVKVAVFFGGLSIKKDEEVLKKNCPHIVVGTPGRILALARNKSLNLKHIKHFILDECDKMLEQLDMRRDVQEIFRMTPHEKQVMMFSATLSKEIRPVCRKFMQDPMEIFVDDETKLTLHGLQQYYVKLKDNEKNRKLFDLLDVLEFNQVVIFVKSVQRCIALAQLLVEQNFPAIAIHRGMPQEERLSRYQQFKDFQRRILVATNLFGRGMDIERVNIAFNYDMPEDSDTYLHRVARAGRFGTKGLAITFVSDENDAKILNDVQDRFEVNISELPDEIDISSYIEQTR

SEQ ID NO: 1314 - protein, 370 aa, Homo sapiens
  misc_feature (0)...(0): Polypeptide Accession Number Q14012
MLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRDCCVEPGTELSPTLPHQL

SEQ ID NO: 1315 - protein, 909 aa, Homo sapiens
  misc_feature (0)...(0): Polypeptide Accession Number Q14028
MPRELSRIEEEKEDEEEEEEEEEEEEEEEVTEVLLDSCVVSQVGVGQSEEDGTRPQSTSDQKLWEEVGEEAKKEAEEKAKEEAEEVAEEEAEKEPQDWAETKEEPEAEAEAASSGVPATKQHPEVQVEDTDADSCPLMAEENPPSTVLPPPSPAKSDTLIVPSSASGTHRKKLPSEDDEAEELKALSPAESPVVAWSDPTTPKDTDGQDRAASTASTNSAIINDRLQELVKLFKERTEKVKEKLIDPDVTSDEESPKPSPAKKAPEPAPDTKPAEAEPVEEEHYCDMLCCKFKHRPWKKYQFPQSIDPLTNLMYVLWLFFVVMAWNWNCWLIPVRWAFPYQTPDNIHHWLLMDYLCDLIYFLDITVFQTRLQFVRGGDIITDKKDMRNNYLKSRRFKMDLLSLLPLDFLYLKVGVNPLLRLPRCLKYMAFFEFNSRLESILSKAYVYRVIRTTAYLLYSLHLNSCLYYWASAYQGLGSTHWVYDGVGNSYIRCYYFAVKTLITIGGLPDPKTLFEIVFQLLNYFTGVFAFSVMIGQMRDVVGAATAGQTYYRSCMDSTVKYMNFYKIPKSVQNRVKTWYEYTWHSQGMLDESELMVQLPDKMRLDLAIDVNYNIVSKVALFQGCDRQMIFDMLKRLRSVVYLPNDYVCKKGEIGREMYIIQAGQVQVLGGPDGKSVLVTLKAGSVFGEISLLAVGGGNRRTANVVAHGFTNLFILDKKDLNEILVHYPESQKLLRKKARRMLRSNNKPKEEKSVLILPPRAGTPKLFNAALAMTGKMGGKGAKGGKLAHLRARLKELAALEAAAKHEELVEQAKSSQDVKGEEGSAAPDQHTHPKEAATDPPAPRTPPEPPGSPPSSPPPASLGSCEGEEEGPAEPEEHSVRICMSPGPEPGEQILSVKMPEEREEKAE

SEQ ID NO: 1316 - protein, 348 aa, Homo sapiens
  misc_feature (0)...(0): Polypeptide Accession Number Q14093
MSLPRFQRVNFGPYDNYIPVSELSKKSWNQQHFALLFPKPQRPGTKRRSKPSQIRDNTVSIIDEEQLRGDRRQPLWMYRSLMRISERPSVYLAARRQPLKPTRTVEVDSKAAEIGKKGEDKTTQKDTTDSESELKQGKKDSKKGKDIEKGKEEKLDAKKDSKKGKKDAEKGKDSATESEDEKGGAKKDNKKDKKDSNKGKDSATESEGEKGGTEKDSKKGKKDSKKGKDSAIELQAVKADEKKDEDGKKDANKGDESKDAKKDAKEIKKGKKDKKKPSSTDSDSKDDVKKESKKDATKDAKKVAKKDTEKESADSKKDAKKNAKKDAKKDAKKNAKKDEKKDAKKKGK

SEQ ID NO: 1317 - protein, 424 aa, Homo sapiens
  misc_feature (0)...(0): Polypeptide Accession Number Q14141
TDIARQVGEGCRTVPLAGHVGFDSLPDQLVNKSVSQGFCFNILCVGETGLGKSTLMDTLFNTKFEGEPATHTQPGVQLQSNTYDLQESNVRLKLTIVSTVGFGDQINKEDSYKPIVEFIDAQFEAYLQEELKIRRVLHTYHDSRIHVCLYFIAPTGHSLKSLDLVTMKKLDSKVNIIPIIAKADAISKSELTKFKIKITSELVSNGVQIYQFPTDDESVAEINGTMNAHLPFAVIGSTEELKIGNKMMRARQYPWGTVQVENEAHCDFVKLREMLIRVNMEDLREQTHTRHYELYRRCKLEEMGFKDTDPDSKPFSLQETYEAKRNEFLGELQKKEEEMRQMFVQRVKEKEAELKEAEKELHEKFDRLKKLHQDEKKKLEDKKKSLDDEVNAFKQRKTAAELLQSQGSQAGGSQTLKRDKEKKN

SEQ ID NO: 1318 - protein, 515 aa, Homo sapiens
  misc_feature (0)...(0): Polypeptide Accession Number Q14154
MWRLPGLLGRALPRTLGPSLWRVTPKSTSPDGPQTTSSTLLVPVPNLDRSGPHGPGTSGGPRSHGWKDAFQWMSSRVSPNTLWDAISWGTLAVLALQLARQIHFQASLPAGPQRVEHCSWHSPLDRFFSSPLWHPCSSLRQHILPSPDGPAPRHTGLREPRLGQEEASAQPRNFSHNSLRGARPQDPSEEGPGDFGFLHASSSIESEAKPAQPQPTGEKEQDKSKTLSLEEAVTSIQQLFQLSVSIAFNFLGTENMKSGDHTAAFSYFQKAAARGYSKAQYNAGLCHEHGRGTPRDISKAVLYYQLAASQGHSLAQYRYARCLLRDPASSWNPERQRAVSLLKQAADSGLREAQAFLGVLFTKEPYLDEQRAVKYLWLAANNGDSQSRYHLGICYEKGLGVQRNLGEALRCYQQSAALGNEAAQERLRALFSMGAAAPGPSDLTVTGLKSFSSPSLCSLNTLLAGTSRLPHASSTGNLGLLCRSGHLGASLEASSRAIPPHPYPLERSVVRLGFG

SEQ ID NO: 1319 - protein, 885 aa, Homo sapiens
  misc_feature (0)...(0): Polypeptide Accession Number Q14156
AGGGSCRPLGCVTAGSASAPSTLRPSPFASSRPPRPSNGRHGAVGAPCAAPLSLGAAASAVEIAMPTRVCCCCSALRPRYKRLVDNIFPEDPKDGLVKTDMEKLTFYAVSAPEKLDRIGSYLAERLSRDVVRHRSGYVLIAMEALDQLLMACHSQSIKPFVESFLHMVAKLLESGEPKLQVLGTNSFVKFANIEEDTPSYHRRYDFFVSRFSAMCHSCHSDPEIRTEIRIAGIRGIQGVVRKTVNDELRATIWEPQHMDKIVPSLLFNMQKIEEVDSRIGPPSSPSATDKEENPAVLAENCFRELLGRATFGNMNNAVRPVFAHLDHHKLWDPNEFAVHCFKIIMYSIQAQYSHHVIQEILGHLDARKKDAPRVRAGIIQVLLEAVAIAAKGSIGPTVLEVFNTLLKHLRLSVEFEANDLQGGSVGSVNLNTSSKDNDEKIVQNAIIQTIGFFGSNLPDYQRSEIMMFIMGKVPVFGTSTHTLDISQLGDLGTRRIQIMLLRSLLMVTSGYKAKTIVTALPGSFLDPLLSPSLMEDYELRQLVLEVMHNLMDRHDNRAKLRGIRIIPDVADLKIKREKICRQDTSFMKKNGQQLYRHIYLGCKEEDNVQKNYELLYTSLALITIELANEEVVIDLIRLAIALQDSAIINEDNLPMFHRCGIMALVAAYLNFVSQMIAVPAFCQHVSKVIEIRTMEAPYFLPEHIFRDKCMLPKSLEKHEKDLYFLTNKIAESLGGSGYSVERLSVPYVPQVTDEDRLSRRKSIVDTVSIQVDILSNNVPSDDVVSNTEEITFEALKKAIDTSGMEEQEKEKRRLVIEKFQKAPFEEIAAQCESKANLLHDRLAQILELTIRPPPSPSGTLTITSGHAQYQSVPVYEMKFPDLCVY

SEQ ID NO: 1320 - protein, 983 aa, Homo sapiens
  misc_feature (0)...(0): Polypeptide Accession Number Q14157
MMTSVGTNRARGNWEQPQNQNQTQHKQRPQATAEQIRLAQMISDHNDADFEEKVKQLIDITGKNQDECVIALHDCNGDVNRAINVLLEGNPDTHSWEMVGKKKGVSGQKDGGQTESNEEGKENRDRDRDYSRRRGGPPRRGRGASRGREFRGQENGLDGTKSGGPSGRGTERGRRGRGRGRGGSGRRGGRFSAQGMGTFNPADYAEPANTDDNYGNSSGNTWNNTGHFEPDDGTSAWRTATEEWGTEDWNEDLSETKIFTASNVSSVPLPAENVTITAGQRIDLAVLLGKTPSTMENDSSNLDPSQAPSLAQPLVFSNSKQTAISQPASGNTFSHHSMVSMLGKGFGDVGEAKGGSTTGSQFLEQFKTAQALAQLAAQHSQSGSTTTSSWDMGSTTQSPSLVQYDLKNPSDSAVHSPFTKRQAFTPSSTMMEVFLQEKSPAVATSTAAPPPPSSPLPSKSTSAPQMSPGSSDNQSSSPQPAQQKLKQQKKKASLTSKIPALAVEMPGSADISGLNLQFGALQFGSEPVLSDYESTPTTSASSSQAPSSLYTSTASESSSTISSNQSQESGYQSGPIQSTTYTSQNNAQGPLYEQRSTQTRRYPSSISSSPQKDLTQAKNGFSSVQATQLQTTQSVEGATGSAVKSDSPSTSSIPPLNETVSAASLLTTTNQHSSSLGGLSHSEEIPNTTTTQHSSTLSTQQNTLSSSTSSGRTSTSTLLHTSVESEANLHSSSSTFSTTSSTVSAPPPVVSVSSSLNSGSSLGLSLGSNSTVTASTRSSVATTSGKAPPNLPPGVPPLLPNPYIMAPGLLHAYPPQVYGYDDLQMLQTRFPLDYYSIPFPTPTTPLTGRDGSLASNPYSGDLTKFGRGDASSPAPATTLAQPQQNQTQTHHTTQQTFLNPALPPGYSYTSLPYYTGVPGLPSTFQYGPAVFPVAPTSSKQHGVNVSVNASATPFQQPSGYGSHGYNTGRKYPPPYKHFWTAES

SEQ ID NO: 1321 - protein, 1270 aa, Homo sapiens
  misc_feature (0)...(0): Polypeptide Accession Number Q14203
YNRTPSGSRMSAEASARPLRVGSRVEVIGKGHRGTVAYVGATLFATGKWVGVILDEAKGKNDGTVQGRKYFTCDEGHGIFVRQSQIQVFEDGADTTSPETPDSSASKVLKREGTDTTAKTSKLRGLKPKKAPTARKTTTRRPKPTRPASTGVAGASSSLGPSGSASAGELSSSEPSTPAQTPLAAPIIPTPVLTSPGAVPPLPSPSKEEEGLRAQVRDLEEKLETLRLKRAEDKAKLKELEKHKIQLEQVQEWKSKMQEQQADLQRRLKEARKEAKEALEAKERYMEEMADTADAIEMATLDKEMAEERAESLQQEVEALKERVDELTTDLEILKAEIEEKGSDGAASSYQLKQLEEQNARLKDALVRMRDLSSSEKQEHVKLQKLMEKKNQELEVVRQQRERLQEELSQAESTIDELKEQVDAALGAEEMVEMLTDRNLNLEEKVRELRETVGDLEAMNEMNDELQENARETELELREQLDMAGARVREAQKRVEAAQETVADYQQTIKKYRQLTAHLQDVNRELTNQQEASVERQQQPPPETFDFKIKFAETKAHAKAIEMELRQMEVAQANRHMSLLTAFMPDSFLRPGGDHDCVLVLLLMPRLICKAELIRKQAQEKFELSENCSERPGLRGAAGEQLSFAAGLVYSLSLLQATLHRYEHALSQCSVDVYKKVGSLYPEMSAHERSLDFLIELLHKDQLDETVNVEPLTKAIKYYQHLYSIHLAEQPEDCTMQLADHIKFTQSALDCMSVEVGRLRAFLQGGQEATDIALLLRDLETSCSDIRQFCKKIRRRMPGTDAPGIPAALAFGPQVSDTLLDCRKHLTWVVAVLQEVAAAAAQLIAPLAENEGLLVAALEELAFKASEQIYGTPSSSPYECLRQSCNILISTMNKLATAMQEGEYDAERPPSKPPPVELRAAALRAEITDAEGLGLKLEDRETVIKELKKSLKIKGEELSEANVRLSLLEKKLDSAAKDADERIEKVQTRLEETQALLRKKEKEFEETMDALQADIDQLEAEKAELKQRLNSQSKRTIEGLRGPPPSGIATLVSGIAGEEQQRGAIPGQAPGSVPGPGLVKDSPLLLQQISAMRLHISQLQHENSILKGAQMKASLASLPPLHVAKLSHEGPGSELPAGALYRKTSQLLETLNQLSTHTHVVDITRTSPAAKSPSAQLMEQVAQLKSLSDTVEKLKDEVLKETVSQRPGATVPTDFATFPSSAFLRAKEEQQDDTVYMGKVTFSCAAGFGQRHRLVLTQEQLHQLHSRLIS

SEQ ID NO: 1322 - protein, 305 aa, Homo sapiens
  misc_feature (0)...(0): Polypeptide Accession Number Q14232
MDDKELIEYFKSQMKEDPDMASAVAAIRTLLEFLKRDKGETIQGLRANLTSAIETLCGVDSSVAVSSGGELFLRFISLASLEYSDYSKCKKIMIERGELFLRRISLSRNKIADLCHTFIKDGATILTHAYSRVVLRVLEAAVAAKKRFSVYVTESQPDLSGKKMAKALCHLNVPVTVVLDAAVGYIMEKADLVIVGAEGVVENGGIINKIGTNQMAVCAKAQNKPFYVVAESFKFVRLFPLNQQDVPDKFKYKADTLKVAQTGQDLKEEHPWVDYTAPSLITLLFTDLGVLTPSAVSDELIKLYL

SEQ ID NO: 1323 - protein, 407 aa, Homo sapiens
  misc_feature (0)...(0): Polypeptide Accession Number Q14240
MSGGSADYNREHGGPEGMDPDGVIESNWNEIVDNFDDMNLKESLLRGIYAYGFEKPSAIQQRAIIPCIKGYDVIAQAQSGTGKTATFAISILQQLEIEFKETQALVLAPTRELAQQIQKVILALGDYMGATCHACIGGTNVRNEMQKLQAEAPHIVVGTPGRVFDMLNRRYLSPKWIKMFVLDEADEMLSRGFKDQIYEIFQKLNTSIQVVFASATMPTDVLEVTKKFMRDPIRILVKKEELTLEGIKQFYINVEREEWKLDTLCDLYETLTITQAVIFLNTRRKVDWLTEKMHARDFTVSALHGDMDQKERDVIMREFRSGSSRVLITTDLLARGIDVQQVSLVINYDLPTNRENYIHRIGRGGRFGRKGVAINFVTEEDKRILRDIETFYNTTVEEMPMNVADLI

SEQ ID NO: 1324 - protein, 550 aa, Homo sapiens
  misc_feature (0)...(0): Polypeptide Accession Number Q14247
MWKASAGHAVSIAQDDAGADDWETDPDFVNDVSEKEQRWGAKTVQGSGHQEHINIHKLRENVFQEHQTLKEKELETGPKASHGYGGKFGVEQDRMDKSAVGHEYQSKLSKHCSQVDSVRGFGGKFGVQMDRVDQSAVGFEYQGKTEKHASQKDYSSGFGGKYGVQADRVDKSAVGFDYQGKTEKHESQRDYSKGFGGKYGIDKDKVDKSAVGFEYQGKTEKHESQKDYVKGFGGKFGVQTDRQDKCALGWDHQEKLQLHESQKDYKTGFGGKFGVQSERQDSAAVGFDYKEKLAKHESQQDYSKGFGGKYGVQKDRMDKNASTFEDVTQVSSAYQKTVPVEAVTSKTSNIRANFENLAKEKEQEDRRKAEAERAQRMAKERQEQEEARRKLEEQARAKTQTPPVSPAPQPTEERLPSSPVYEDAASFKAELSYRGPVSGTEPEPVYSMEAADYREASSQQGLAYATEAVYESAEAPGHYPAEDSTYDEYENDLGYTAVALYDYQAAGDDEISFDPDDIITNIEMIDDGWWRGVCKGRYGLFPANYVELRQ

SEQ ID NO: 1325 - protein, 662 aa, Homo sapiens
  misc_feature (0)...(0): Polypeptide Accession Number Q14392
MRPQILLLLALLTLGLAAQHQDKVPCKMVDKKVSCQVLGLLQVPSVLPPDTETLDLSGNQLRSILASPLGFYTALRHLDLSTNEISFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLMDIEDGAFEGLPRLTHLNLSRNSLTCISDFSLQQLRVLDLSCNSIEAFQTASQPQAEFQLTWLDLRENKLLHFPDLAALPRLIYLNLSNNLIRLPTGPPQDSKGIHAPSEGWSALPLSAPSGNASGRPLSQLLNLDLSYNEIELIPDSFLEHLTSLCFLNLSRNCLRTFEARRLGSLPCLMLLDLSHNALETLELGARALGSLRTLLLQGNALRDLPPYTFANLASLQRLNLQGNRVSPCGGPDEPGPSGCVAFSGITSLRSLSLVDNEIELLRAGAFLHTPLTELDLSSNPGLEVATGALGGLEASLEVLALQGNGLMVLQVDLPCFICLKRLNLAENRLSHLPAWTQAVSLEVLDLRNNSFSLLPGSAMGGLETSLRRLYLQGNPLSCCGNGWLAAQLHQGRVDVDATQDLICRFSSQEEVSLSHVRPEDCEKGGLKNINLIIILTFILVSAILLTTLAACCCVRRQKFNQQYKA

SEQ ID NO: 1326 - protein, 340 aa, Homo sapiens
  misc_feature (0)...(0): Polypeptide Accession Number Q14565
MKEDQVVAEEPGFQDEEESLFQDIDLLQKHGINVADIKKLKSVGICTIKGIQMTTRRALCNVKGLSEAKVDKIKEAANKLIEPGFLTAFEYSEKRKMVFHITTGSQEFDKLLGGGIESMAITEAFGEFRTGKTQLSHTLCVTAQLPGAGGYPGGKIIFIDTENTFRPDRLRDIADRFNVDHDAVLDNVLYARAYTSEHQMELLDYVAAKFHEEAGIFKLLIIDSIMALFRVDFSGRGELAERQQKLAQMLSRLQKISEEYNVAVFVTNQMTADPGATMTFQADPKKPIGGHILAHASTTRISLRKGRGELRIAKIYDSPEMPENEATFAITAGGIGDAKE

SEQ ID NO: 1327 - protein, 1992 aa, Homo sapiens
  misc_feature (0)...(0): Polypeptide Accession Number Q14669
MSNRPNNNPGGSLRRSQRNTAGAQPQDDSIGGRSCSSSSAVIVPQPEDPDRANTSERQKTGQVPKKDNSRGVKRSASPDYNRTNSPSSAKKPKALQHTESPSETNKPHSKSKKRHLDQEQQLKSAQSPSTSKAHTRKSGATGGSRSQKRKRTESSCVKSGSGSESTGAEERSAKPTKLASKSATSAKAGCSTITDSSSAASTSSSSSAVASASSTVPPGARVKQGKDQNKARRSRSASSPSPRRSSREKEQSKTGGSSKFDWAARFSPKVSLPKTKLSLPGSSKSETSKPGPSGLQAKLASLRKSTKKRSESPPAELPSLRRSTRQKTTGSCASTSRRGSGLGKRGAAEARRQEKMADPESNQEAVNSSAARTDEAPQGAAGAVGMTTSGESESDDSEMGRLQALLEARGLPPHLFGPLGPRMSQLFHRTIGSGASSKAQQLLQGLQASDESQQLQAVIEMCQLLVMGNEETLGGFPVKSVVPALITLLQMEHNFDIMNHACRALTYMMEALPRSSAVVVDAIPVFLEKLQVIQCIDVAEQALTALEMLSRRHSKAILQAGGLADCLLYLEFFSINAQRNALAIAANCCQSITPDEFHFVADSLPLLTQRLTHQDKKSVESTCLCFARLVDNFQHEENLLQQVASKDLLTNVQQLLVVTPPILSSGMFIMVVRMFSLMCSNCPTLAVQLMKQNIAETLHFLLCGASNGSCQEQIDLVPRSPQELYELTSLICELMPCLPKEGIFAVDTMLKKGNAQNTDGAIWQWRDDRGLWHPYNRIDSRIIEQINEDTGTARAIQRKPNPLANSNTSGYSESKKDDARAQLMKEDPELAKSFIKTLFGVLYEVYSSSAGPAVRHKCLRAILRIIYFADAELLKDVLKNHAVSSHIASMLSSQDLKIVVGALQMAEILMQKLPDIFSVYFRREGVMHQVKHLAESESLLTSPPKACTNGSGSMGSTTSVSSGTATAATHAAADLGSPSLQHSRDDSLDLSPQGRLSDVLKRKRLPKRGPRRPKYSPPRDDDKVDNQAKSPTTTQSPKSSFLASLNPKTWGRLSTQSNSNNIEPARTAGGSGLARAASKDTISNNREKIKGWIKEQAHKFVERYFSSENMDGSNPALNVLQRLCAATEQLNLQVDGGAECLVEIRSIVSESDVSSFEIQHSGFVKQLLLYLTSKSEKDAVSREIRLKRFLHVFFSSPLPGEEPIGRVEPVGNAPLLALVHKMNNCLSQMEQFPVKVHDFPSGNGTGGSFSLNRGSQALKFFNTHQLKCQLQRHPDCANVKQWKGGPVKIDPLALVQAIERYLVVRGYGRVREDDEDSDDDGSDEEIDESLAAQFLNSGNVRHRLQFYIGEHLLPYNMTVYQAVRQFSIQAEDERESTDDESNPLGRAGIWTKTHTIWYKPVREDEESNKDCVGGKRGRAQTAPTKTSPRNAKKHDELWHDGVCPSVSNPLEVYLIPTPPENITFEDPSLDVILLLRVLHAISRYWYYLYDNAMCKEIIPTSEFINSKLTAKANRQLQDPLVIMTGNIPTWLTELGKTCPFFFPFDTRQMLFYVTAFDRDRAMQRLLDTNPEINQSDSQDSRVAPRLDRKKRTVNREELLKQAESVMQDLGSSRAMLEIQYENEVGTGLGPTLEFYALVSQELQRADLGLWRGEEVTLSNPKGSQEGTKYIQNLQGLFALPFGRTAKPAHIAKVKMKFRFLGKLMAKAIMDFRLVDLPLGLPFYKWMLRQETSLTSHDLFDIDPVVARSVYHLEDIVRQKKRLEQDKSQTKESLQYALETLTMNGCSVEDLGLDFTLPGFPNIELKKGGKDIPVTIHNLEEYLRLVIFWALNEGVSRQFDSFRDGFESVFPLSHLQYFYPEELDQLLCGSKADTWDAKTLMECCRPDHGYTHDSRAVKFLFEILSSFDNEQQRLFLQFVTGSPRLPVGGFRSLNPPLTIVRKTFESTENPDDFLPSVMTCVNYLKLPDYSSIEIMREKLLIAAREGQQSFHLS

SEQ ID NO: 1328 - protein, 1157 aa, Homo sapiens
  misc_feature (0)...(0): Polypeptide Accession Number Q14687
QHVSAEVELRGPGMKGSSLSSESSPVSSPATNHSSPASTPKRVPMGPIIVPPGGHSVPSTPPVVTIAPTKTVNGVWRSESRQDAGPRSSSGGRERLIVEPPLPQEKAGGPAIPSHLLSTPYPFGLSPSSVVQDSRFPPLNLQRPVHHVVPPSTVTEDYLRSFRPYHTTDDLRMSSLPPLGLDPATAAAYYHPSYLAPHPFPHPAFRMDDSYCLSALRSPFYPIPTPGSLPPLHPSAMHLHLSGVRYPPELSHSSLAALHSERMSGLSAERLQMDEELRREREREREREREREADREREKEREREREKEREQEKEREREKERERELERQREQRAREKELLAAKALEPSFLPVAELHGLRGHATEERGKPSEQLTPTRAEKLKDASLQAPKPVQHPLHPVPTPHHTVPSLISNHGIFSLPSSSAATALLIQRTNEEEKWLARQRRLRQEKEDRQSQVSEFRQQVLEQHLDMGRPPVPAEAEHRPESTTRPGPNRHEPGGRDPPQHFGGPPPLISPKPQLHAAPTALWNPVSLMDNTLETRRAESHSLHSHPAAFEPSRQAAVPLVKVERVFCPEKAEEGPRKREPAPLDKYQPPPPPPREGGSLEHQPFLPGPGPFLAELEKSTQTILGQQRASLPQAATFGELSGPLKPGSPYRPPVPRAPDPAYIYDEFLQQRRRLVSKLDLEERRRREAQEKGYYYDLDDSYDESDEEEVRAHLRCVAEQPPLKLDTSSEKLEFLQLFGLTTQQQKEELVAQKRRKRRRMLRERSPSPPTIQSKRQTPSPRLALSTRYSPDEMNNSPNFEEKKKFLTIFNLTHISAEKRKDKERLVEMLRAMKQKALSAAVADSLTNSPRDSPAVSLSEPATQQASLDVEKPVGVAASLSDIPKAAEPGKLEQVRPQELSRVQELAPASGEKARLSEAPGGKKSLSMLHYIRGAAPKDIPVPLSHSTNGKSKPWEPFVAEEFAHQFHESVLQSTQKALQKHKGSVAVLSAEQNHKVDTSVHYNIPELQSSSRAPPPQHNGQQEPPTARKGPPTQELDRDSEEEEEEDDEDGEDEEEVPKRKWQGIEAVFEAYQEHIEEQNLERQVLQTQCRRLEARHYSLSLTAEQLSHSVAELRSQKQKMVSERERLQAELDHLRKCLALPAMHWPRGYLKGYPR

SEQ ID NO: 1329 - protein, 1884 aa, Homo sapiens
  misc_feature (0)...(0): Polypeptide Accession Number Q14690
VAGCRRRGAGDPNMANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIPLLLTSLSFKVLKHPDKKFRVGQALRATVVGPDSSKTFLCLSLTGPHKLEEGEVAMGRVVKVTPNEGLTVSFPFGKIGTVSIFHMSDSYSETPLEDFVPQKVVRCYILSTADNVLTLSLRSSRTNPETKSKVEDPEINSIQDIKEGQLLRGYVGSIQPHGVFFRLGPSVVGLARYSHVSQHSPSKKALYNKHLPEGKLLTARVLRLNHQKNLVELSFLPGDTGKPDVLSASLEGQLTKQEERKTEAEERDQKGEKKNQKRNEKKNQKGQEEVEMPSKEKQQPQKPQAQKRGGRECRESGSEQERVSKKPKKAGLSEEDDSLVDVYYREGKEEAEETNVLPKEKQTKPAEAPRLQLSSGFAWNVGLDSLTPALPPLAESSDSEEDEKPHQATIKKSKKERELEKQKAEKELSRIEEALMDPGRQPESADDFDRLVLSSPNSSILWLQYMAFHLQATEIEKARAVAERALKTISFREEQEKLNVWVALLNLENMYGSQESLTKVFERAVQYNEPLKVFLHLADIYAKSEKFQEAGELYNRMLKRFRQEKAVWIKYGAFLLRRSQAAASHRVLQRALECLPSKEHVDVIAKFAQLEFQLGDAERAKAIFENTLSTYPKRTDVWSVYIDMTIKHGSQKDVRDIFERVIHLSLAPKRMKFFFKRYLDYEKQHGTEKDVQAVKAKALEYVEAKSSVLED

SEQ ID NO: 1330 - protein, 521 aa, Homo sapiens
  misc_feature (0)...(0): Polypeptide Accession Number Q14814
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLTEDHLDLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 1331 - protein, 361 aa, Homo sapiens
  misc_feature (0)...(0): Polypeptide Accession Number Q15019
MSKQQPTQFINPETPGYVGFANLPNQVHRKSVKKGFEFTLMVVGESGLGKSTLINSLFLTDLYPERVIPGAAEKIERTVQIEASTVEIEERGVKLRLTVVDTPGYGDAINCRDCFKTIISYIDEQFERYLHDESGLNRRHIIDNRVHCCFYFISPFGHGLKPLDVAFMKAIHNKVNIVPVIAKADTLTLKERERLKKRILDEIEEHNIKIYHLPDAESDEDEDFKEQTRLLKASIPFSVVGSNQLIEAKGKKVRGRLYPWGVVEVENPEHNDFLKLRTMLITHMQDLQEVTQDLHYENFRSERLKRGGRKVENEDMNKDQILLEKEAELRRMQEMIARMQAQMQMQMQGGDGDGGALGHHV

SEQ ID NO: 1332 - protein, 971 aa, Homo sapiens
  misc_feature (0)...(0): Polypeptide Accession Number Q15032
MRMSDTVTVKDETATMKDLEAEVKDTTRVENLIKSENYGKILVEKNEHCIENNIDLQEKIQIQLTQSFEKEEKPSKDEAEKEKASDKLPRKMLSRDSSQEYTDSTGIDLHEFLVNTLKNNPRDRMMLLKLEQEILDFIGNNESPRKKFPPMTSYHRMLLHRVAAYFGLDHNVDQSGKSVIVNKTSNTRIPDQKFNEHIKDDKGEDFQKRYILKRDNSSFDKDDNQVRIRLKDDRRSKSIEEREEEYQRARDRIFSQDSLCSQENYIIDKRLQDEDASSTQQRRQIFRVNKDASGRSTNSHQSSTENELKYSEPRPWSSTDSDSSLRNLKPAVTKASSFSGISVLTRGDSSGSSKSIGRLSKTGQPFINPDGSPVVYNPPMTQQPVRSQVPGPPQPPLPAPPQQPAANHIFSQQDNLGSQFSHMSLARQPSADGSDPHAAMFQSTVVLQSPQQSGYIMTAAPPPHPPPPPPPPPPPPPLPPGQPVPTAGYPASGHPVSQPVLQQQGYIQQPSPQMPACYCAPGHYHSSQPQYRPVPSVHYNSHLNQPLPQPAQQTGYQVIPNQQQNYQGIVGVQQPQSQSLVSGQPNSIGNQIQGVVIPYTSVPTYQVSLPQGSQGIPHQTYQQPVMFPNQSNQGSMPTTGMPVYYSVIPPGQQNNLSSSVGYLQHPGSEQVQFPRTTSPCSSQQLQGHQCTAGPPPPPGGGMVMMQLSVPNNPQSCAHSPPQWKQNKYYCDHQRGQKCVEFSSVDNIVQHSPQLSSPIISPAQSPAPAQLSTLKTVRPSGPPLSIMPQFSRPFVPGQGDSRYPLLGQPLQYNPPAVLHGHIPNQQGQPGSRHGNRGRRQAKKAASTDLGAGETVVGKVLEITELPDGITRMEAEKLFGELFKIGAKIRWLRDPQSQPRRHPLCCGSGDNTANPERSKPSDLASTYTVLATFPSISAAQNALKKQINSVNKFKLRTSKKHYDFHILERASSQ

SEQ ID NO: 1333 - protein, 470 aa, Homo sapiens
  misc_feature (0)...(0): Polypeptide Accession Number Q15036
MHFSIPETESRSGDSGGSAYVAYNIHVNGVLHCRVRYSQLLGLHEQLRKEYGANVLPAFPPKKLFSLTPAEVEQRREQLEKYMQAVRQDPLLGSSETFNSFLRRAQQETQQVPTEEVSLEVLLSNGQKVLVNVLTSDQTEDVLEAVAAKLDLPDDLIGYFSLFLVREKEDGAFSFVRKLQEFELPYVSVTSLRSQEYKIVLRKSYWDSAYDDDVMENRVGLNLLYAQTVSDIERGWILVTKEQHRQLKSLQEKVSKKEFLRLAQTLRHYGYLRFDACVADFPEKDCPVVVSAGNSELSLQLRLPGQQLREGSFRVTRMRCWRVTSSVPLPSGSTSSPGRGRGEVRLELAFEYLMSKDRLQWVTITSPQAIMMSICLQSMVDELMVKKSGGSIRKMLRRRVGGTLRRSDSQQAVKSPPLLESPDATRESMVKLSSKLSAVSLRGIGSPSTDASASDVHGNFAFEGIGDEDL

SEQ ID NO: 1334 - protein, 292 aa, Homo sapiens
  misc_feature (0)...(0): Polypeptide Accession Number Q15072
MSHLSQQKIYSGENPFACKVCGKVFSHKSNLTEHEHFHTREKPFECNECGKAFSQKQYVIKHQNTHTGEKLFECNECGKSFSQKENLLTHQKIHTGEKPFECKDCGKAFIQKSNLIRHQRTHTGEKPFVCKECGKTFSGKSNLTEHEKIHIGEKPFKCSECGTAFGQKKYLIKHQNIHTGEKPYECNECGKAFSQRTSLIVHVRIHSGDKPYECNVCGKAFSQSSSLTVHVRSHTGEKPYGCNECGKAFSQFSTLALHLRIHTGKKPYQCSECGKAFSQKSHHIRHQKIHTH

SEQ ID NO: 1335 - protein, 289 aa, Homo sapiens
  misc_feature (0)...(0): Polypeptide Accession Number Q15181
MSGFSTEERAAPFSLEYRVFLKNEKGQYISPFHDIPIYADKDVFHMVVEVPRWSNAKMEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNDINDVKRLKPGYLEATVDWFRRYKVPDGKPENEFAFNAEFKDKDFAIDIIKSTHDHWKALVTKKTNGKGISCMNTTLSESPFKCDPDAARAIVDALPPPCESACTVPTDVDKWFHHQKN

SEQ ID NO: 1336 - protein, 919 aa, Homo sapiens
  misc_feature (0)...(0): Polypeptide Accession Number Q15269
MKFAYRFSNLLGTVYRRGNLNFTCNGNSVISPVGNRVTVFDLKNNKSDTLPLATRYNVKCVGLSPDGRLAIIVDEGGDALLVSLVCRSVLHHFHFKGSVHSVSFSPDGRKFVVTKGNIAQMYHAPGKKREFNAFVLDKTYFGPYDETTCIDWTDDSRCFVVGSKDMSTWVFGAERWDNLIYYALGGHKDAIVACFFESNSLDLYSLSQDGVLCMWQCDTPPEGLRLKPPAGWKADLLQREEEEEEEEDQEGDRETTIRGKATPAEEEKTGKVKYSRLAKYFFNKEGDFNNLTAAAFHKKSHLLVTGFASGIFHLHELPEFNLIHSLSISDQSIASVAINSSGDWIAFGCSGLGQLLVWEWQSESYVLKQQGHFNSMVALAYSPDGQYIVTGGDDGKVKVWNTLSGFCFVTFTEHSSGVTGVTFTATGYVVVTSSMDGTVRAFDLHRYRNFRTFTSPRPTQFSCVAVDASGEIVSAGAQDSFEIFVWSMQTGRLLDVLSGHEGPISGLCFNPMKSVLASASWDKTVRLWDMFDSWRTKETLALTSDALAVTFRPDGAELAVATLNSQITFWDPENAVQTGSIEGRHDLKTGRKELDKITAKHAAKGKAFTALCYSADGHSILAGGMSKFVCIYHVREQILMKRFEISCNLSLDAMEEFLNRRKMTEFGNLALIDQDAGQEDGVAIPLPGVRKGDMSSRHFKPEIRVTSLRFSPTGRCWAATTTEGLLIYSLDTRVLFDPFELDTSVTPGRVREALRQQDFTRAILMALRLNESKLVQEALEAVPRGEIEVVTSSLPELYVEKVLEFLASSFEVSRHLEFYLLWTHKLLMLHGQKLKSRAGTLLPVIQFLQKSIQRHLDDLSKLCSWNHYNMQYALAVSKQRGTKRSLDPLGSEEEAEASEDDSLHLLGGGGRDSEEEMLA

SEQ ID NO: 1337 - protein, 297 aa, Homo sapiens
  misc_feature (0)...(0): Polypeptide Accession Number Q15274
MDAEGLALLLPPVTLAALVDSWLREDCPGLNYAALVSGAGPSQAALWAKSPGVLAGQPFFDAIFTQLNCQVSWFLPEGSKLVPVARVAEVRGPAHCLLLGERVALNTLARCSGIASAAAAAVEAARGAGWTGHVAGTRKTTPGFRLVEKYGLLVGGAASHRYDLGGLVMLKDNHVVPPGGVEKAVRAARQAADFALKVEVECSSLQEVVQAAEAGADLVLLDNFKPEELHPTATALKAQFPSVAVEASGGITLDNLPQFCGPHIDVISMGMLTQAVPALDFSLKLFAKEVAPVPKIH

SEQ ID NO: 1338 - protein, 424 aa, Homo sapiens
  misc_feature (0)...(0): Polypeptide Accession Number Q15427
MAAGPISERNQDATVYVGGLDEKVSEPLLWELFLQAGPVVNTHMPKDRVTGQHQGYGFVEFLSEEDADYAIKIMNMIKLYGKPIRVNKASAHNKNLDVGANIFIGNLDPEIDEKLLYDTFSAFGVILQTPKIMRDPDTGNSKGYAFINFASFDASDAAIEAMNGQYLCNRPITVSYAFKKDSKGERHGSAAERLLAAQNPLSQADRPHQLFADAPPPPSAPNPVVSSLGSGLPPPGMPPPGSFPPPVPPPGALPPGIPPAMPPPPMPPGAAGHGPPSAGTPGAGHPGHGHSHPHPFPPGGMPHPGMSQMQLAHHGPHGLGHPHAGPPGSGGQPPPRPPPGMPHPGPPPMGMPPRGPPFGSPMGHPGPMPPHGMRGPPPLMPPHGYTGPPRPPPYGYQRGPLPPPRPTPRPPVPPRGPLRGPLPQ

SEQ ID NO: 1339 - protein, 976 aa, Homo sapiens [sequence omitted]

SEQ ID NO: 1340 - protein, 765 aa, Homo sapiens
  misc_feature (0)...(0): Polypeptide Accession Number Q15436
MTTYLEFIQQNEERDGVRFSWNVWPSSRLEATRMVVPVAALFTPLKERPDLPPIQYEPVLCSRTTCRAVLNPLCQVDYRAKLWACNFCYQRNQFPPSYAGISELNQPAELLPQFSSIEYVVLRGPQMPLIFLYVVDTCMEDEDLQALKESMQMSLSLLPPTALVGLITFGRMVQVHELGCEGISKSYVFRGTKDLSAKQLQEMLGLSKVPVTQATRGPQVQQPPPSNRFLQPVQKIDMNLTDLLGELQRDPWPVPQGKRPLRSSGVALSIAVGLLECTFPNTGARIMMFIGGPATQGPGMVVGDELKTPIRSWHDIDKDNAKYVKKGTKHFEALANRAATTGHVIDIYACALDQTGLLEMKCCPNLTGGYMVMGDSFNTSLFKQTFQRVFTKDMHGQFKMGFGGTLEIKTSREIKISGAIGPCVSLNSKGPCVSENEIGTGGTCQWKICGLSPTTTLAIYFEVVNQHNAPIPQGGRGAIQFVTQYQHSSGQRRIRVTTIARNWADAQTQIQNIAASFDQEAAAILMARLAIYRAETEEGPDVLRWLDRQLIRLCQKFGEYHKDDPSSFRFSETFSLYPQFMFHLRRSSFLQVFNNSPDESSYYRHHFMRQDLTQSLIMIQPILYAYSFSGPPEPVLLDSSSILADRILLMDTFFQILIYHGETIAQWRKSGYQDMPEYENFRHLLQAPVDDAQEILHSRFPMPRYIDTEHGGSQARFLLSKVNPSQTHNNMYAWGQESGAPILTDDVSLQVFMDHLKKLAVSSAA

SEQ ID NO: 1341 - protein, 767 aa, Homo sapiens [sequence omitted]

SEQ ID NO: 1342 - protein, 800 aa, Homo sapiens [sequence omitted]

SEQ ID NO: 1343 - protein, 211 aa, Homo sapiens
  misc_feature (0)...(0): Polypeptide Accession Number Q15544
MDDAHESPSDKGGETGESDETAAVPGDPGATDTDGIPEETDGDADVDLKEAAAEEGELESQDVSDLTTVEREDSSLLNPAAKKLKIDTKEKKEKKQKVDEDEIQKMQILVSSFSEEQLNRYEMYRRSAFPKAAIKRLIQSITGTSVSQNVVIAMSGISKVFVGEVVEEALDVCEKWGEMPPLQPKHMREAVRRLKSKGQIPNSKHKKIIFF

SEQ ID NO: 1344 - protein, 349 aa, Homo sapiens
  misc_feature (0)...(0): Polypeptide Accession Number Q15545
MSKSKDDAPHELESQFILRLPPEYASTVRRAVQSGHVNLKDRLTIELHPDGRHGIVRVDRVPLASKLVDLPCVMESLKTIDKKTFYKTADICQMLVSTVDGDLYPPVEEPVASTDPKASKKKDKDKEKKFIWNHGITLPLKNVRKRRFRKTAKKKYIESPDVEKEVKRLLSTDAEAVSTRWEIIAEDETKEAENQGLDISSPGMSGHRQGHDSLEHDELREIFNDLSSSSEDEDETQHQDEEDINIIDTEEDLERQLQDKLNESDEQHQENEGTNQLVMGIQKQIDNMKGKLQETQDRAKRQEDLIMKVENLALKNRFQAVLDELKQKEDREKEQLSSLQEELESLLEK

SEQ ID NO: 1345 - protein, 482 aa, Homo sapiens
  misc_feature (0)...(0): Polypeptide Accession Number Q15696
MAAPEKMTFPEKPSHKKYRAALKKEKRKKRRQELARLRDSGLSQKEEEEDTFIEEQQLEEEKLLERERQRLHEEWLLREQKAQEEFRIKKEKEEAAKKRQEEQERKLKEQWEEQQRKEREEEEQKRQEKKEKEEALQKMLDQAENELENGTTWQNPEPPVDFRVMEKDRANCPFYSKTGACRFGDRCSRKHNFPTSSPTLLIKSMFTTFGMEQCRRDDYDPDASLEYSEEETYQQFLDFYEDVLPEFKNVGKVIQFKVSCNLEPHLRGNVYVQYQSEEECQAALSLFNGRWYAGRQLQCEFCPVTRWKMAICGLFEIQQCPRGKHCNFLHVFRNPNNEFWEANRDIYLSPDRTGSSFGKNSERRERMGHHDDYYSRLRGRRNPSPDHSYKRNGESERKSSRHRGKKSHKRTSKSRERHNSRSRGRNRDRSRDRSRGRGSRSRSRSRSRRSRRSRSQSSSRSRSRGRRRSGNRDRTVQSPKSK

SEQ ID NO: 1346 - protein, 372 aa, Homo sapiens
  misc_feature (0)...(0): Polypeptide Accession Number Q15759
MSGPRAGFYRQELNKTVWEVPQRLQGLRPVGSGAYGSVCSAYDARLRQKVAVKKLSRPFQSLIHARRTYRELRLLKHLKHENVIGLLDVFTPATSIEDFSEVYLVTTLMGADLNNIVKCQAGAHQGARLALDEHVQFLVYQLLRGLKYIHSAGIIHRDLKPSNVAVNEDCELRILDFGLARQADEEMTGYVATRWYRAPEIMLNWMHYNQTVDIWSVGCIMAELLQGKALFPGSDYIDQLKRIMEVVGTPSPEVLAKISSEHARTYIQSLPPMPQKDLSSIFRGANPLAIDLLGRMLVLDSDQRVSAAEALAHAYFSQYHDPEDEPEAEPYDESVEAKERTLEEWKELTYQEVLSFKPPEPPKPPGSLEIEQ

SEQ ID NO: 1347 - protein, 520 aa, Homo sapiens
  misc_feature (0)...(0): Polypeptide Accession Number Q15811
MEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQ

SEQ ID NO: 1348 - protein, 433 aa, Homo sapiens
  misc_feature (0)...(0): Polypeptide Accession Number Q15831
MEVVDPQQLGMFTEGELMSVGMDTFIHRIDSTEVIYQPRRKRAKLIGKYLMGDLLGEGSYGKVKEVLDSETLCRRAVKILKKKKLRRIPNGEANVKKEIQLLRRLRHKNVIQLVDVLYNEEKQKMYMVMEYCVCGMQEMLDSVPEKRFPVCQAHGYFCQLIDGLEYLHSQGIVHKDIKPGNLLLTTGGTLKISDLGVAEALHPFAADDTCRTSQGSPAFQPPEIANGLDTFSGFKVDIWSAGVTLYNITTGLYPFEGDNIYKLFENIGKGSYAIPGDCGPPLSDLLKGMLEYEPAKRFSIRQIRQHSWFRKKHPPAEAPVPIPPSPDTKDRWRSMTVVPYLEDLHGADEDEDLFDIEDDIIYTQDFTVPGQVPEEEASHNGQRRGLPKAVCMNGTEAAQLSTKSRAEGRAPNPARKACSASSKIRRLSACKQQ

SEQ ID NO: 1349 - protein, 617 aa, Homo sapiens
  misc_feature (0)...(0): Polypeptide Accession Number Q16134
MLVPLAKLSCLAYQCFHALKIKKNYLPLCAIRWSSTSTVPRITTHYTIYPRDKDKRWEGVNMERFAEEADVVIVGAGPAGLSAAVRLKQLAVAHEKDIRVCLVEKAAQIGAHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLSPFREFQRWKHHPSIRPTLEGGKRIAYGARALNEGGFQSIPKLTFPGGLLIGCSPGFMNVPKIKGTHTAMKSGILAAESIFNQLTSENLQSKTIGLHVTEYEDNLKNSWVWKELYSVRNIRPSCHGVLGVYGGMIYTGIFYWILRGMEPWTLKHKGSDFERLKPAKDCTPIEYPKPDGQISFDLLSSVALSGTNHEHDQPAHLTLRDDSIPVNRNLSIYDGPEQRFCPAGVYEFVPVEQGDGFRLQINAQNCVHCKTCDIKDPSQNINWVVPEGGGGPAYNGM

SEQ ID NO: 1350 - protein, 418 aa, Homo sapiens
  misc_feature (0)...(0): Polypeptide Accession Number Q16181
MVAQQKNLEGYVGFANLPNQVYRKSVKRGFEFTLMVVGESGLGKSTLINSLFLTDLYSPEYPGPSHRIKKTVQVEQSKVLIKEGGVQLLLTIVDTPGFGDAVDNSNCWQPVIDYIDSKFEDYLNAESRVNRRQMPDNRVQCCLYFIAPSGHGLKPLDIEFMKRLHEKVNIIPLIAKADTLTPEECQQFKKQIMKEIQEHKIKIYEFPETDDEEENKLVKKIKDRLPLAVVGSNTIIEVNGKRVRGRQYPWGIAEVENGEHCDFTILRNMKIRTHMQDLKDVTNNVHYENYRSRKLAAVTYNGVDNNKNKGQLTKSPLAQMEEERREHVAKMKKMEMEMEQVFEMKVKEKVQKLKDSEAELQRRHEQMKKNLEAQHKELEEKRRQFEDEKANWEAQQRILEQQNSSRTLEKNKKKGKIF

SEQ ID NO: 1351 - protein, 694 aa, Homo sapiens
  misc_feature (0)...(0): Polypeptide Accession Number Q16281
MAKINTQYSHPSRTHLKVKTSDRDLNRAENGLSRAHSSSEETSSVLQPGIAMETRGLADSGQGSFTGQGIARLSRLIFLLRRWAARHVHHQDQGPDSFPDRFRGAELKEVSSQESNAQANVGSQEPADRGRSAWPLAKCNTNTSNNTEEEKKTKKKDAIVVDPSSNLYYRWLTAIALPVFYNWYLLICRACFDELQSEYLMLWLVLDYSADVLYVLDVLVRARTGFLEQGLMVSDTNRLWQHYKTTTQFKLDVLSLVPTDLAYLKVGTNYPEVRFNRLLKFSRLFEFFDRTETRTNYPNMFRIGNLVLYILIIIHWNACIYFAISKFIGFGTDSWVYPNISIPEHGRLSRKYIYSLYWSTLTLTTIGETPPPVKDEEYLFVVVDFLVGVLIFATIVGNVGSMISNMNASRAEFQAKIDSIKQYMQFRKVTKDLETRVIRWFDYLWANKKTVDEKEVLKSLPDKLKAEIAINVHLDTLKKVRIFQDCEAGLLVELVLKLRPTVFSPGDYICKKGDIGKEMYIINEGKLAVVADDGVTQFVVLSDGSYFGEISILNIKGSKSGNRRTANIRSIGYSDLFCLSKDDLMEALTEYPEAKKALEEKGRQILMKDNLIDEELARAGADPKDLEEKVEQLGSSLDTLQTRFARLLAEYNATQMKMKQRLSQLESQVKGGGDKPLADGEVPGDATKTEDKQQ

SEQ ID NO: 1352 - protein, 360 aa, Homo sapiens
  misc_feature (0)...(0): Polypeptide Accession Number Q16539
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHIDQLKLILRLVGTPGAELLKKISSESARNYIQSLTQMPKMNFANVFIGANPLAVDLLEKMLVLDSDKRITAAQALAHAYFAQYHDPDDEPVADPYDQSFESRDLLIDEWKSLTYDEVISFVPPPLDQEEMES

SEQ ID NO: 1353 - protein, 473 aa, Homo sapiens
  misc_feature (0)...(0): Polypeptide Accession Number Q16566
MLKVTVPSCSASSCSSVTASAAPGTASLVPDYWIDGSNRDALSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAADAVKQILEAVAYLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVRKLIVLDPKKRLTTFQALQHPWVTGKAANFVHMDTAQKKLQEFNARRKLKAAVKAVVASSRLGSASSSHGSIQESHKASRDPSPIQDGNEDMKAIPEGEKIQGDGAQAAVKGAQAELMKVQALEKVKGADINAEEAPKMVPKAVEDGIKVADLELEEGLAEEKLKTVEEAAAPREGQGSSAVGFEVPQQDVILPEY

SEQ ID NO: 1354 - protein, 425 aa, Homo sapiens
  misc_feature (0)...(0): Polypeptide Accession Number Q16576
MASKEMFEDTVEERVINEEYKIWKKNTPFLYDLVMTHALQWPSLTVQWLPEVTKPEGKDYALHWLVLGTHTSDEQNHLVVARVHIPNDDAQFDASHCDSDKGEFGGFGSVTGKIECEIKINHEGEVNRARYMPQNPHIIATKTPSSDVLVFDYTKHPAKPDPSGECNPDLRLRGHQKEGYGLSWNSNLSGHLLSASDDHTVCLWDINAGPKEGKIVDAKAIFTGHSAVVEDVAWHLLHESLFGSVADDQKLMIWDTRSNTTSKPSHLVDAHTAEVNCLSFNPYSEFILATGSADKTVALWDLRNLKLKLHTFESHKDEIFQVHWSPHNETILASSGTDRRLNVWDLSKIGEEQSAEDAEDGPPELLFIHGGHTAKISDFSWNPNEPWVICSVSEDNIMQIWQMAENIYNDEESDVTTSELEGQGS

SEQ ID NO: 1355 - protein, 264 aa, Homo sapiens
  misc_feature (0)...(0): Polypeptide Accession Number Q16594
MESGKTASPKSMPKDAQMMAQILKDMGITEYEPRVINQMLEFAFRYVTTILDDAKIYSSHAKKATVDADDVRLAIQCRADQSFTSPPPRDFLLDIARQRNQTPLPLIKPYSGPRLPPDRYCLTAPNYRLKSLQKKASTSAGRITVPRLSVGSVTSRPSTPTLGTPTPQTMSVSTKVGTPMSLTGQRFTVQMPTSQSPAVKASIPATSAVQNVLINPSLIGSKNILITTNMMSSQNTANESSNALKRKREDDDDDDDDDDDYDNL

SEQ ID NO: 1356 - protein, 458 aa, Homo sapiens
  misc_feature (0)...(0): Polypeptide Accession Number Q16600
MASTITGSQDCIVNHRGEVDGEPELDISPCQQWGEASSPISRNRDSVMTLQSGCFENIESETYLPLKVSSQIDTQDSSVKFCKNEPQDHQESRRLFVMEESTERKVIKGESCSENLQVKLVSDGQELASPLLNGEATCQNGQLKESLDPIDCNCKDIHGWKSQVVSCSQQRGHTEEKPCDHNNCGKILNTSPDGHPYEKIHTAEKQYEGSQCGKNFSQSSELLLHQRDHTEEKPYKCEQCGKGFTRSSSLLIHQAVHTDEKPYKCEKCGKGFTRSSSLLIHHAVHTGEKPYKCDKCGKGFSQSSKLHIHQRVHTGEKPYECEECGMSFSQRSNLHIHQRDHTGERPYKCGECGKGFSQSSNLHIHRCIHTGEKPYQCYECGKGFSQSSDLRIHLRVHTGEKPYHCGKCGKGFSQSSKLLIHQRVHTGEKPYECSKCGKGFSQSSNLHSHQRVHKKDPR

SEQ ID NO: 1357 - protein, 649 aa, Homo sapiens [sequence omitted]

SEQ ID NO: 1358 - protein, 152 aa, Homo sapiens
  misc_feature (0)...(0): Polypeptide Accession Number Q16781
MAGLPRRIIKETQRLLAEPVPGIKAEPDESNARYFHVVIAGPQDSPFEGGTFKLELFLPEEYPMAAPKVRFMTKIYHPNVDKLGRICLDILKDKWSPALQIRTVLLSIQALLSAPNPDDPLANDVAEQWKTNEAQAIETARAWTRLYAMNNI

SEQ ID NO: 1359 - protein, 1713 aa, Homo sapiens
  misc_feature (0)...(0): Polypeptide Accession Number Q16787
MGWLWIFGAALGQCLGYSSQQQRVPFLQPPGQSQLQASYVEFRPSQGCSPGYYRDHKGLYTGRCVPCNCNGHSNQCQDGSGICVNCQHNTAGEHCERCQEGYYGNAVHGSCRACPCPHTNSFATGCVVNGGDVRCSCKAGYTGTQCERCAPGYFGNPQKFGGSCQPCSCNSNGQLGSCHPLTGDCINQEPKDSSPAEECDDCDSCVMTLLNDLATMGEQLRLVKSQLQGLSASAGLLEQMRHMETQAKDLRNQLLNYRSAISNHGSKIEGLERELTDLNQEFETLQEKAQVNSRKAQTLNNNVNRATQSAKELDVKIKNVIRNVHILLKQISGTDGEGNNVPSGDFSREWAEAQRMMRELRNRNFGKHLREAEADKRESQLLLNRIRTWQKTHQGENNGLANSIRDSLNEYEAKLSDLRARLQEAAAQAKQANGLNQENERALGAIQRQVKEINSLQSDFTKYLTTADSSLLQTNIALQLMEKSQKEYEKLAASLNEARQELSDKVRELSRSAGKTSLVEEAEKHARSLQELAKQLEEIKRNASGDELVRCAVDAATAYENILNAIKAAEDAANRAASASESALQTVIKEDLPRKAKTLSSNSDKLLNEAKMTQKKLKQEVSPALNNLQQTLNIVTVQKEVIDTNLTTLRDGLHGIQRGDIDAMISSAKSMVRKANDITDEVLDGLNPIQTDVERIKDTYGRTQNEDFKKALTDADNSVNKLTNKLPDLWRKIESINQQLLPLGNISDNMDRIRELIQQARDAASKVAVPMRFNGKSGVEVRLPNDLEDLKGYTSLSLFLQRPNSRENGGTENMFVMYLGNKDASRDYIGMAVVDGQLTCVYNLGDREAELQVDQILTKSETKEAVMDRVKFQRIYQFARLNYTKGATSSKPETPGVYDMDGRNSNTLLNLDPENVVFYVGGYPPDFKLPSRLSFPPYKGCIELDDLNENVLSLYNFKKTFNLNTTEVEPCRRRKEESDKNYFEGTGYARVPTQPHAPIPTFGQTIQTTVDRGLLFFAENGDRFISLNIEDGKLMVRYKLNSELPKERGVGDAINNGRDHSIQIKIGKLQKRMWINVDVQNTIIDGEVFDFSTYYLGGIPIAIRERFNISTPAFRGCMKNLKKTSGVVRLNDTVGVTKKCSEDWKLVRSASFSRGGQLSFTDLGLPPTDHLQASFGFQTFQPSGILLDHQTWTRNLQVTLEDGYIELSTSDSGGPIFKSPQTYMDGLLHYVSVISDNSGLRLLIDDQLLRNSKRLKHISSSRQSLRLGGSNFEGCISNVFVQRLSLSPEVLDLTSNSLKRDVSLGGCSLNKPPFLMLLKGSTRFNKTKTFRINQLLQDTPVASPRSVKVWQDACSPLPKTQANHGALQFGDIPTSHLLFKLPQELLKPRSQFAVDMQTTSSRGLVFHTGTKNSFMALYLSKGRLVFALGTDGKKLRIKSKEKCNDGKWHTVVFGHDGEKGRLVVDGLRAREGSLPGNSTISIRAPVYLGSPPSGKPKSLPTNSFVGCLKNFQLDSKPLYTPSSSFGVSSCLGGPLEKGIYFSEEGGHVVLAHSVLLGPEFKLVFSIRPRSLTGILIHIGSQPGKHLCVYLEAGKVTASMDSGAGGTSTSVTPKQSLCDGQWHSVAVTIKQHILHLELDTDSSYTAGQIPFPPASTQEPLHLGGAPANLTTLRIPVWKSFFGCLRNIHVNHIPVPVTEALEVQGPVSLNGCPDQ

SEQ ID NO: 1360 - protein, 386 aa, Homo sapiens
  misc_feature (0)...(0): Polypeptide Accession Number Q16816
TRDEALPDSHSAQDFYENYEPKEILGRGVSSVVRRCIHKPTSQEYAVKVIDVTGGGSFSPEEVRELREATLKEVDILRKVSGHPNIIQLKDTYETNTFFFLVFDLMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTLLAGSPPFWHRKQMLMLRMIMSGNYQFGSPEWDDYSDTVKDLVSRFLVVQPQNRYTAEEALAHPFFQQYLVEEVRHFSPRGKFKVIALTVLASVRIYYQYRRVKPVTREIVIRDPYALRPLRRLIDAYAFRIYGHWVKKGQQQNRAALFENTPKAVLLSLAEEDY

SEQ ID NO: 1361 - protein, 520 aa, Homo sapiens
  misc_feature (0)...(0): Polypeptide Accession Number Q16875
MPLELTQSRVQKIWVPVDHRPSLPRSCGPKLTNSPTVIVMVGLPARGKTYISKKLTRYLNWIGVPTKVFNVGEYRREAVKQYSSYNFFRPDNEEAMKVRKQCALAALRDVKSYLAKEGGQIAVFDATNTTRERRHMILHFAKENDFKAFFIESVCDDPTVVASNIMEVKISSPDYKDCNSAEAMDDFMKRISCYEASYQPLDPDKCDRDLSLIKVIDVGRRFLVNRVQDHIQSRIVYYLMNIHVQPRTIYLCRHGENEHNLQGRIGGDSGLSSRGKKFASALSKFVEEQNLKDLRVWTSQLKSTIQTAEALRLPYEQWKALNEIDAGVCEELTYEEIRDTYPEEYALREQDKYYYRYPTGESYQDLVQRLEPVIMELERQENVLVICHQAVLRCLLAYFLDKSAEEMPYLKCPLHTVLKLTPVAYGCRVESIYLNVESVCTHRERSEDAKKGPNPLMRRNSVTPLASPEPTKKPRINSFEEHVASTSAALPSCLPPEVPTQLPGQNMKGSRSSADSSRKH

SEQ ID NO: 1362 - protein, 468 aa, Homo sapiens
  misc_feature (0)...(0): Polypeptide Accession Number Q16877
ASPRELTQNPLKKIWMPYSNGRPALHACQRGVCMTNCPTLIVMVGLPARGKTYISKKLTRYLNWIGVPTREFNVGQYRRDVVKTYKSFEFFLPDNEEGLKIRKQCALAALRDVRRFLSEEGGHVAVFDATNTTRERRATIFNFGEQNGYKTFFVESICVDPEVIAANIVQVKLGSPDYVNRDSDEATEDFMRRIECYENSYESLDEDLDRDLSYIKIMDVGQSYVVNRVADHIQSRIVYYLMNIHVTPRSIYLCRHGESELNLKGRIGGDPGLSPRGREFAKSLAQFISDQNIKDLKVWTSQMKRTIQTAEALGVPYEQWKVLNEIDAGVCEEMTYEEIQDNYPLEFALRDQDKYRYRYPKGESYEDLVQRLEPVIMELERQENVLVICHQAVMRCLLAYFLDKAAEQLPYLKCPLHTVLKLTPVAYGCKVESIFLNVAAVNTHRDRPQNVDISRPPEEALVTVPAHQ

SEQ ID NO: 1363 - protein, 389 aa, Homo sapiens [sequence omitted]

SEQ ID NO: 1364 - protein, 917 aa, Homo sapiens
  misc_feature (0)...(0): Polypeptide Accession Number Q92636
MAFIRKKQQEQQLQLYSKERFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNSIAETWKNCLDGATDFKELIPEFYGDDVSFLVNSLKLDLGKRQGGQMVDDVELPPWASSPEDFLQKSKDALESNYVSEHLHEWIDLIFGYKQKGSDAVGAHNVFHPLTYEGGVDLNSIQDPDEKVAMLTQILEFGQTPKQLFVTPHPRRITPKFKSLSQTSSYNASMADSPGEESFEDLTEESKTLAWNNITKLQLHEHYKIHKEAVTGITVSRNGSSVFTTSQDSTLKMFSKESKMLQRSISFSNMALSSCLLLPGDATVITSSWDNNVYFYSIAFGRRQDTLMGHDDAVSKICWHDNRLYSASWDSTVKVWSGVPAEMPGTKRHHFDLLAELEHDVSVDTISLNAASTLLVSGTKEGTVNIWDLTTATLMHQIPCHSGIVCDTAFSPDSRHVLSTGTDGCLNVIDVQTGMLISSMTSDEPQTCFVWDGNSVLSGSQSGELLVWDLLGAKISERIQGHTGAVTCIWMNEQCSSIITGGEDRQIIFWKLQY

SEQ ID NO: 1365 - protein, 567 aa, Homo sapiens
  misc_feature (0)...(0): Polypeptide Accession Number Q92696
MHGRLKVKTSEEQAEAKRLEREQKLKLYQSATQAVFQKRQAGELDESVLELTSQILGANPDFATLWNCRREVLQQLETQKSPEELAALVKAELGFLESCLRVNPKSYGTWHHRCWLLGRLPEPNWTRELELCARFLEVDERNFHCWDYRRFVATQAAVPPAEELAFTDSLITRNFSNYSSWHYRSCLLPQLHPQPDSGPQGRLPEDVLLKELELVQNAFFTDPNDQSAWFYHRWLLGRADPQDALRCLHVSRDEACLTVSFSRPLLVGSRMEILLLMVDDSPLIVEWRTPDGRNRPSHVWLCDLPAASLNDQLPQHTFRVIWTAGDVQKECVLLKGRQEGWCRDSTTDEQLFRCELSVEKSTVLQSELESCKELQELEPENKWCLLTIILLMRALDPLLYEKETLQYFQTLKAVDPMRATYLDDLRSKFLLENSVLKMEYAEVRVLHLAHKDLTVLCHLEQLLLVTHLDLSHNRLRTLPPALAALRCLEVLQASDNAIESLDGVTNLPRLQELLLCNNRLQQPAVLQPLASCPRLVLLNLQGNPLCQAVGILEQLAELLPSVSSVLT

SEQ ID NO: 1366 - protein, 425 aa, Homo sapiens
  misc_feature (0)...(0): Polypeptide Accession Number Q92764
MYSSSPCKLPSLSPVARSFSACSVGLGRSSYRATSCLPALCLPAGGFATSYSGGGGWFGEGILTGNEKETMQSLNDRLAGYLEKVRHVEQENASLESRIREWCEQQVPYMCPDYQSYFRTIEELQKKTLCSKAENARLVVEIDNAKLAADDFRTKYETEVSLRQLVESDINGLRRILDDLTLCKSDLEAQVESLKEELLCLKKNHEEEVNSLRCQLGDRLNVEVDAAPPVDLNRVLEEMRCQYETLVENNRRDAEDWLDTQSEELNQQVVSSSEQLQSCQAEIIELRRTVNALEIELQAQHSMRDALESTLAETEARYSSQLAQMQCMITNVEAQLAEIRADLERQNQEYQVLLDVRARLECEINTYRGLLESEDSKLPCNPCAPDYSPSKSCLPCLPAASCGPSAARTNCSPRPICVPCPGGRF

SEQ ID NO: 1367 - protein, 488 aa, Homo sapiens
  misc_feature (0)...(0): Polypeptide Accession Number Q92769
MAYSQGGGKKKVCYYYDGDIGNYYYGQGHPMKPHRIRMTHNLLLNYGLYRKMEIYRPHKATAEEMTKYHSDEYIKFLRSIRPDNMSEYSKQMHIFNVGEDCPAFDGLFEFCQLSTGGSVAGAVKLNRQQTDMAVNWAGGLHHAKKYEASGFCYVNDIVLAILELLKYHQRVLYIDIDIHHGDGVEEAFYTTDRVMTVSFHKYGEYFPGTGDLRDIGAGKGKYYAVNFPMCDGIDDESYGQIFKPIISKVMEMYQPSAVVLQCGADSLSGDRLGCFNLTVKGHAKCVEVVKTFNLPLLMLGGGGYTIRNVARCWTYETAVALDCEIPNELPYNDYFEYFGPDFKLHISPSNMTNQNTPEYMEKIKQRLFENLRMLPHAPGVQMQAIPEDAVHEDSGDEDGEDPDKRISIRASDKRIACDEEFSDSEDEGEGGRRNVADHKKGAKKARIEEDKKETEDKKTDVKEEDKSKDNSGEKTDTKGTKSEQLSNP

SEQ ID NO: 1368 - protein, 318 aa, Homo sapiens
  misc_feature (0)...(0): Polypeptide Accession Number Q92781
MWLPLLLGALLWAVLWLLRDRQSLPASNAFVFITGCDSGFGRLLALQLDQRGFRVLASCLTPSGAEDLQRVASSRLHTTLLDITDPQSVQQAAKWVEMHVKEAGLFGLVNNAGVAGIIGPTPWLTRDDFQRVLNVNTMGPIGVTLALLPLLQQARGRVINITSVLGRLAANGGGYCVSKFGLEAFSDSLRRDVAHFGIRVSIVEPGFFRTPVTNLESLEKTLQACWARLPPATQAHYGGAFLTKYLKMQQRIMNLICDPDLTKVSRCLEHALTARHPRTRYSPGWDAKLLWLPASYLPASLVDAVLTWVLPKPAQAVY

SEQ ID NO: 1369 - protein, 391 aa, Homo sapiens
  misc_feature (0)...(0): Polypeptide Accession Number Q92785
MAAVVENVVKLLGEQYYKDAMEQCHNYNARLCAERSVRLPFLDSQTGVAQSNCYIWMEKRHRGPGLASGQLYSYPARRWRKKRRAHPPEDPRLSFPSIKPDTDQTLKKEGLISQDGSSLEALLRTDPLEKRGAPDPRVDDDSLGEFPVTNSRARKRILEPDDFLDDLDDEDYEEDTPKRRGKGKSKGKGVGSARKKLDASILEDRDKPYACDICGKRYKNRPGLSYHYAHSHLAEEEGEDKEDSQPPTPVSQRSEEQKSKKGPDGLALPNNYCDFCLGDSKINKKTGQPEELVSCSDCGRSGHPSCLQFTPVMMAAVKTYRWQCIECKCCNICGTSENDDQLLFCDDCDRGYHMYCLTPSMSEPPEGSWSCHLCLDLLKEKASIYQNQNSS

SEQ ID NO: 1370 - protein, 2442 aa, Homo sapiens
  misc_feature (0)...(0): Polypeptide Accession Number Q92793
MAENLLDGPPNPKRAKLSSPGFSANDSTDFGSLFDLENDLPDELIPNGGELGLLNSGNLVPDAASKHKQLSELLRGGSGSSINPGIGNVSASSPVQQGLGGQAQGQPNSANMASLSAMGKSPLSQGDSSAPSLPKQAASTSGPTPAASQALNPQAQKQVGLATSSPATSQTGPGICMNANFNQTHPGLLNSNSGHSLINQASQGQAQVMNGSLGAAGRGRGAGMPYPTPAMQGASSSVLAETLTQVSPQMTGHAGLNTAQAGGMAKMGITGNTSPFGQPFSQAGGQPMGATGVNPQLASKQSMVNSLPTFPTDIKNTSVTNVPNMSQMQTSVGIVPTQAIATGPTADPEKRKLIQQQLVLLLHAHKCQRREQANGEVRACSLPHCRTMKNVLNHMTHCQAGKACQVAHCASSRQIISHWKNCTRHDCPVCLPLKNASDKRNQQTILGSPASGIQNTIGSVGTGQQNATSLSNPNPIDPSSMQRAYAALGLPYMNQPQTQLQPQVPGQQPAQPQTHQQMRTLNPLGNNPMNIPAGGITTDQQPPNLISESALPTSLGATNPLMNDGSNSGNIGTLSTIPTAAPPSSTGVRKGWHEHVTQDLRSHLVHKLVQAIFPTPDPAALKDRRMENLVAYAKKVEGDMYESANSRDEYYHLLAEKIYKIQKELEEKRRSRLHKQGILGNQPALPAPGAQPPVIPQAQPVRPPNGPLSLPVNRMQVSQGMNSFNPMSLGNVQLPQAPMGPRAASPMNHSVQMNSMGSVPGMAISPSRMPQPPNMMGAHTNNMMAQAPAQSQFLPQNQFPSSSGAMSVGMGQPPAQTGVSQGQVPGAALPNPLNMLGPQASQLPCPPVTQSPLHPTPPPASTAAGMPSLQHTTPPGMTPPQPAAPTQPSTPVSSSGQTPTPTPGSVPSATQTQSTPTVQAAAQAQVTPQPQTPVQPPSVATPQSSQQQPTPVHAQPPGTPLSQAAASIDNRVPTPSSVASAETNSQQPGPDVPVLEMKTETQAEDTEPDPGESKGEPRSEMMEEDLQGASQVKEETDIAEQKSEPMEVDEKKPEVKVEVKEEEESSSNGTASQSTSPSQPRKKIFKPEELRQALMPTLEALYRQDPESLPFRQPVDPQLLGIPDYFDIVKNPMDLSTIKRKLDTGQYQEPWQYVDDVWLMFNNAWLYNRKTSRVYKFCSKLAEVFEQEIDPVMQSLGYCCGRKYEFSPQTLCCYGKQLCTIPRDAAYYSYQNRYHFCEKCFTEIQGENVTLGDDPSQPQTTISKDQFEKKKNDTLDPEPFVDCKECGRKMHQICVLHYDIIWPSGFVCDNCLKKTGRPRKENKFSAKRLQTTRLGNHLEDRVNKFLRRQNHPEAGEVFVRVVASSDKTVEVKPGMKSRFVDSGEMSESFPYRTKALFAFEEIDGVDVCFFGMHVQEYGSDCPPPNTRRVYISYLDSIHFFRPRCLRTAVYHEILIGYLEYVKKLGYVTGHIWACPPSEGDDYIFHCHPPDQKIPKPKRLQEWYKKMLDKAFAERIIHDYKDIFKQATEDRLTSAKELPYFEGDFWPNVLEESIKELEQEEEERKKEESTAASETTEGSQGDSKNAKKKNNKKTNKNKSSISRANKKKPSMPNVSNDLSQKLYATMEKHKEVFFVIHLHAGPVINTLPPIVDPDPLLSCDLMDGRDAFLTLARDKHWEFSSLRRSKWSTLCMLVELHTQGQDRFVYTCNECKHHVETRWHCTVCEDYDLCINCYNTKSHAHKMVKWGLGLDDEGSSQGEPQSKSPQESRRVSIQRCIQSLVHACQCRNANCSLPSCQKMKRVVQHTKGCKRKTNGGCPVCKQLIALCCYHAKHCQENKCPVPFCLNIKHKLRQQQIQHRLQQAQLMRRRMATMNTRNVPQQSLPSPTSAPPGTPTQQPSTPQTPQPPAQPQPSPVSMSPAGFPSVARTQPPTTVSTGKPTSQVPAPPPPAQPPPAAVEAARQIEREAQQQQHLYRVNINNSMPPGRTGMGTPGSQMAPVSLNVPRPNQVSGPVMPSMPPGQWQQAPLPQQQPMPGLPRPVISMQAQAAVAGPRMPSVQPPRSISPSALQDLLRTLKSPSSPQQQQQVLNILKSNPQLMAAFIKQRTAKYVANQPGMQPQPGLQSQPGMQPQPGMHQQPSLQNLNAMQAGVPRPGVPPQQQAMGGLNPQGQALNIMNPGHNPNMASMNPQYREMLRRQLLQQQQQQQQQQQQQQQQQQGSAGMAGGMAGHGQFQQPQGPGGYPPAMQQQQRMQQHLPLQGSSMGQMAAQMGQLGQMGQPGLGADSTPNIQQALQQRILQQQQMKQQIGSPGQPNPMSPQQHMLSGQPQASHLPGQQIATSLSNQVRSPAPVQSPRPQSQPPHSSPSPRIQPQPSPHHVSPQTGSPHPGLAVTMASSIDQGHLGNPEQSAMLPQLNTPSRSALSSELSLVGDTTGDTLEKFVEGL

SEQ ID NO: 1371 - protein, 2004 aa, Homo sapiens
  misc_feature (0)...(0): Polypeptide Accession Number Q92794
MVKLANPLYTEWILEAIKKVKKQKQRPSEERICNAVSSSHGLDRKTVLEQLELSVKDGTILKVSNKGLNSYKDPDNPGRIALPKPRNHGKLDNKQNVDWNKLIKRAVEGLAESGGSTLKSIERFLKGQKDVSALFGGSAASGFHQQLRLAIKRAIGHGRLLKDGPLYRLNTKATNVDGKESCESLSCLPPVSLLPHEKDKPVAEPIPICSFCLGTKEQNREKKPEELISCADCGNSGHPSCLKFSPELTVRVKALRWQCIECKTCSSCRDQGKNADNMLFCDSCDRGFHMECCDPPLTRMPKGMWICQICRPRKKGRKLLQKKAAQIKRRYTNPIGRPKNRLKKQNTVSKGPFSKVRTGPGRGRKRKITLSSQSASSSSEEGYLERIDGLDFCRDSNVSLRFNKKTKGLIDGLTKFFTPSPDGRKARGEVVDYSEQYRIRKRGNRKSSTSDWPTDNQDGWDGKQENEERLFGSQEIMTEKDMELFRDIQEQALQKVGVTGPPDPQVRCPSVIEFGKYEIHTWYSSPYPQEYSRLPKLYLCEFCLKYMKSRTILQQHMKKCGWFHPPANEIYRKNNISVFEVDGNVSTIYCQNLCLLAKLFLDHKTLYYDVEPFLFYVLTQNDVKGCHLVGYFSKEKHCQQKYNVSCIMILPQYQRKGYGRFLIDFSYLLSKREGQAGSPEKPLSDLGRLSYMAYWKSVILECLYHQNDKQISIKKLSKLTGICPQDITSTLHHLRMLDFRSDQFVIIRREKLIQDHMAKLQLNLRPVDVDPECLRWTPVIVSNSVVSEEEEEEAEEGENEEPQCQERELEISVGKSVSHENKEQDSYSVESEKKPEVMAPVSSTRLSKQVLPHDSLPANSQPSRRGRWGRKNRKTQERFGDKDSKLLLEETSSAPQEQYGECGEKSEATQEQYTESEEQLVASEEQPSQDGKPDLPKRRLSEGVEPWRGQLKKSPEALKCRLTEGSERLPRRYSEGDRAVLRGFSESSEEEEEPESPRSSSPPILTKPTLKRKKPFLHRRRRVRKRKHHNSSVVTETISETTEVLDEPFEDSDSERPMPRLEPTFEIDEEEEEEDENELFPREYFRRLSSQDVLRCQSSSKRKSKDEEEDEESDDADDTPILKPVSLLRKRDVKNSPLEPDTSTPLKKKKGWPKGKSRKPIHWKKRPGRKPGFKLSREIMPVSTQACVIEPIVSIPKAGRKPKIQESEETVEPKEDMPLPEERKEEEEMQAEAEEAEEGEEEDAASSEVPAASPADSSNSPETETKEPEVEEEEEKPRVSEEQRQSEEEQQELEEPEPEEEEDAAAETAQNDDHDADDEDDGHLESTKKKELEEQPTREDVKEEPGVQESFLDANMQKSREKIKDKEETELDSEEEQPSHDTSVVSEQMAGSEDDHEEDSHTKEELIELKEEEEIPHSELDLETVQAVQSLTQEESSEHEGAYQDCEETLAACQTLQSYTQADEDPQMSMVEDCHASEHNSPISSVQSHPSQSVRSVSSPNVPALESGYTQISPEQGSLSAPSMQNMETSPMMDVPSVSDHSQQVVDSGFSDLGSIESTTENYENPSSYDSTMGGSICGNSSSQSSCSYGGLSSSSSLTQSSCVVTQQMASMGSSCSMMQQSSVQPAANCSIKSPQSCVVERPPSNQQQQPPPPPPQQPQPPPPQPQPAPQPPPPQQQPQQQPQPQPQQPPPPPPPQQQPPLSQCSMNNSFTPAPMIMEIPESGSTGNISIYERIPGDFGAGSYSQPSATFSLAKLQQLTNTIMDPHAMPYSHSPAVTSYATSVSLSNTGLAQLAPSHPLAGTPQAQATMTPPPNLASTTMNLTSPLLQCNMSATNIGIPHTQRLQGQMPVKGHISIRSKSAPLPSAAAHQQQLYGRSPSAVAMQAGPRALAVQRGMNMGVNLMPTPAYNVNSMNMNTLNAMNSYRMTQPMMNSSYHSNPAYMNQTAQYPMQMQMGMMGSQAYTQQPMQPNPHGNMMYTGPSHHSYMNAAGVPKQSLNGPYMRR

SEQ ID NO: 1372 - protein, 449 aa, Homo sapiens
  misc_feature (0)...(0): Polypeptide Accession Number Q92908
MYQTLAALSSQGPAAYDGAPGGFVHSAAAAAAAAAAASSPVYVPTTRVGSMLPGLPYHLQGSGSGPANHAGGAGAHPGWPQASADSPPYGSGGGAAGGGAAGPGGAGSAAAHVSARFPYSPSPPMANGAAREPGGYAAAGSGGAGGVSGGGSSLAAMGGREPQYSSLSAARPLNGTYHHHHHHHHHHPSPYSPYVGAPLTPAWPAGPFETPVLHSLQSRAGAPLPVPRGPSADLLEDLSESRECVNCGSIQTPLWRRDGTGHYLCNACGLYSKMNGLSRPLIKPQKRVPSSRRLGLSCANCHTTTTTLWRRNAEGEPVCNACGLYMKLHGVPRPLAMKKEGIQTRKRKPKNINKSKTCSGNSNNSIPMTPTSTSSNSDDCSKNTSPTTQPTASGAGAPVMTGAGESTNPENSELKYSGQDGLYIGVSLASPAEVTSSVRPDSWCALALA

SEQ ID NO: 1373 - protein, 863 aa, Homo sapiens
  misc_feature (0)...(0): Polypeptide Accession Number Q92995
MQRRGALFGMPGGSGGRKMAAGDIGELLVPHMPTIRVPRSGDRVYKNECAFSYDSPNSEGGLYVCMNTFLAFGREHVERHFRKTGQSVYMHLKRHAREKVRGASGGALPKRRNSKIFLDLDTDDDLNSDDYEYEDEAKLVIFPDHYEIALPNIEELPALVTIACDAVLSSKSPYRKQDPDTWENELPVSKYANNLTQLDNGVRIPPSGWKCARCDLRENLWLNLTDGSVLCGKWFFDSSGGNGHALEHYRDMGYPLAVKLGTITPDGADVYSFQEEEPVLDPHLAKHLAHFGIDMLHMHGTENGLQDNDIKLRVSEWEVIQESGTKLKPMYGPGYTGLKNLGNSCYLSSVMQAIFSIPEFQRAYVGNLPRIFDYSPLDPTQDFNTQMTKLGHGLLSGQYSKPPVKSELIEQVMKEEHKPQQNGISPRMFKAFVSKSHPEFSSNRQQDAQEFFLHLVNLVERNRIGSENPSDVFRFLVEERIQCCQTRKVRYTERVDYLMQLPVAMEAATNKDELIAYELTRREAEANRRPLPELVRAKIPFSACLQAFSEPENVDDFWSSALQAKSAGVKTSRFASFPEYLVVQIKKFTFGLDWVPKKFDVSIDMPDLLDINHLRARGLQPGEEELPDISPPIVIPDDSKDRLMNQLIDPSDIDESSVMQLAEMGFPLEACRKAVYFTGNMGAEVAFNWIIVHMEEPDFAEPLTMPGYGGAASAGASVFGASGLDNQPPEEIVAIITSMGFQRNQAIQALRATNNNLERALDWIFSHPEFEEDSDFVIEMENNANANIISEAKPEGPRVKDGSGTYELFAFISHMGTSTMSGHYICHIKKEGRWVIYNDHKVCASERPPKDLGYMYFYRRIPS

SEQ ID NO: 1374 - protein, 2547 aa, Homo sapiens
  misc_feature (0)...(0): Polypeptide Accession Number Q93008
MTATTRGSPVGGNDNQGQAPDGQSLPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHRCLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAALIKPFGQCYEFLTLHTVKKYFLPIIEMVPQFLENLTDEELKKEAKNEAKNDALSMIIKSLKNLASRVPGQEETVKNLEIFRLKMILRLLQISSFNGKMNALNEVNKVISSVSYYTHRHGNPEEEEWLTAERMAEWIQQNNILSIVLRDSLHQPQYVEKLEKILRFVIKEKALTLQDLDNIWAAQAGKHEAIVKNVHDLLAKLAWDFSPEQLDHPFDCFKASRTNASKKQREKLLELIRRLAEDDKDGVMAHRVLNLLWNLAHSDDVPVDIMDLALSAHIKILDYSCSQDRDTQKIQWIDRFIEELRTNDKWVIPALKQIREICSLFGEAPQNLSQTQRSPHVFYRHDLINQLQHNHALVTLVAENLVTYMESMRLYARDHEDYDPQTVRLGSRYSHVQEVQERLNFLRFLLKDGQLWLCAPQAKQIWKCLAENAVYLCDREACFKWYSKLMGDEPDLDPDINKDFFESNVLQLDPSLLTENGMKCFERFFKAVNCREGKLVAKRRAYMMDDLELIGLDYLWRVVIQSNDDIASRAIDLLKEIYTNLGPRLQVNQVVIHEDFIQSCFDRLKASYDTLCVLDGDKDSVNCARQEAVRMVRVLTVLREYINECDSDYHEERTILPMSRAFRGKHLSFVVRFPNQGRQVDDLEVWSHTNDTIGSVRRCILNRIKANVAHTKIELFVGGELIDPADDRKLIGQLNLKDKSLITAKLTQISSNMPSSPDSSSDSSTGSPGNHGNHYSDGPNPEVESCLPGVIMSLHPRYISFLWQVADLGSSLNMPPLRDGARVLMKLMPPDSTTIEKLRAICLDHAKLGESSLSPSLDSLFFGPSASQVLYLTEVVYALLMPAGAPLADDSSDFQFHFLKSGGLPLVLSMLTRNNFLPNADMETRRGAYLNALKIAKLLLTAIGYGHVRAVAEACQPGVEGVNPMTQINQVTHDQAVVLQSALQSIPNPSSECMLRNVSVRLAQQISDEASRYMPDICVIRAIQKIIWASGCGSLQLVFSPNEEITKIYEKTNAGNEPDLEDEQVCCEALEVMTLCFALIPTALDALSKEKAWQTFIIDLLLHCHSKTVRQVAQEQFFLMCTRCCMGHRPLLFFITLLFTVLGSTARERAKHSGDYFTLLRHLLNYAYNSNINVPNAEVLFNNEIDWLKRIRDDVKRTGETGIEETILEGHLGVTKELLAFQTSEKKFHIGCEKGGANLIKELIDDFIFPASNVYLQYMRNGELPAEQAIPVCGSPPTINAGFELLVALAVGCVRNLKQIVDSLTEMYYIGTAITTCEALTEWEYLPPVGPRPPKGFVGLKNAGATCYMNSVIQQLYMIPSIRNGILAIEGTGSDVDDDMSGDEKQDNESNVDPRDDVFGYPQQFEDKPALSKTEDRKEYNIGVLRHLQVIFGHLAASRLQYYVPRGFWKQFRLWGEPVNLREQHDALEFFNSLVDSLDEALKALGHPAMLSKVLGGSFADQKICQGCPHRYECEESFTTLNVDIRNHQNLLDSLEQYVKGDLLEGANAYHCEKCNKKVDTVKRLLIKKLPPVLAIQLKRFDYDWERECAIKFNDYFEFPRELDMEPYTVAGVAKLEGDNVNPESQLIQQSEQSESETAGSTKYRLVGVLVHSGQASGGHYYSYIIQRNGGDGERNRWYKFDDGDVTECKMDDDEEMKNQCFGGEYMGEVFDHMMKRMSYRRQKRWWNAYIPFYERMDTIDQDDELIRYISELAITTRPHQIIMPSAIERSVRKQNVQFMHNRMQYSMEYFQFMKKLLTCNGVYLNPPPGQDHLLPEAEEITMISIQLAARFLFTTGFHTKKVVRGSASDWYDALCILLRHSKNVRFWFAHNVLFNVSNRFSEYLLECPSAEVRGAFAKLIVFIAHFSLQDGPCPSPFASPGPSSQAYDNLSLSDHLLRAVLNLLRREVSEHGRHLQQYFNLFVMYANLGVAEKTQLLKLSVPATFMLVSLDEGPGPPIKYQYAELGKLYSVVSQLIRCCNVSSRMQSSINGNPPLPNPFGDPNLSQPIMPIQQNVADILFVRTSYVKKIIEDCSNSEETVKLLRFCCWENPQFSSTVLSELLWQVAYSYPYELRPYLDLLLQILLIEDSWQTHRIHNALKGIPDDRDGLFDTIQRSKNHYQKRAYQCIKCMVALFSNCPVAYQILQGNGDLKRKWTWAVEWLGDELERRPYTGNPQYTYNNWSPPVQSNETSNGYFLERSHSARMTLAKACELCPEEEPDDQDAPDEHESPPPEDAPLYPHSPGSQYQQNNHVHGQPYTGPAAHHMNNPQRTGQRAQENYEGSEEVSPPQTKDQ

SEQ ID NO: 1375 - protein, 1102 aa, Homo sapiens
  misc_feature (0)...(0): Polypeptide Accession Number Q93009
MNHQQQQQQQKAGEQQLSEPEDMEMEAGDTDDPPRITQNPVINGNVALSDGHNTAEEDMEDDTSWRSEATFQFTVERFSRLSESVLSPPCFVRNLPWKIMVMPRFYPDRPHQKSVGFFLQCNAESDSTSWSCHAQAVLKIINYRDDEKSFSRRISHLFFHKENDWGFSNFMAWSEVTDPEKGFIDDDKVTFEVFVQADAPHGVAWDSKKHTGYVGLKNQGATCYMNSLLQTLFFTNQLRKAVYMMPTEGDDSSKSVPLALQRVFYELQHSDKPVGTKKLTKSFGWETLDSFMQHDVQELCRVLLDNVENKMKGTCVEGTIPKLFRGKMVSYIQCKEVDYRSDRREDYYDIQLSIKGKKNIFESFVDYVAVEQLDGDNKYDAGEHGLQEAEKGVKFLTLPPVLHLQLMRFMYDPQTDQNIKINDRFEFPEQLPLDEFLQKTDPKDPANYILHAVLVHSGDNHGGHYVVYLNPKGDGKWCKFDDDVVSRCTKEEAIEHNYGGHDDDLSVRHCTNAYMLVYIRESKLSEVLQAVTDHDIPQQLVERLQEEKRIEAQKRKERQEAHLYMQVQIVAEDQFCGHQGNDMYDEEKVKYTVFKVLKNSSLAEFVQSLSQTMGFPQDQIRLWPMQARSNGTKRPAMLDNEADGNKTMIELSDNENPWTIFLETVDPELAASGATLPKFDKDHDVMLFLKMYDPKTRSLNYCGHIYTPISCKIRDLLPVMCDRAGFIQDTSLILYEEVKPNLTERIQDYDVSLDKALDELMDGDIIVFQKDDPENDNSELPTAKEYFRDLYHRVDVIFCDKTIPNDPGFVVTLSNRMNYFQVAKTVAQRLNTDPMLLQFFKSQGYRDGPGNPLRHNYEGTLRDLLQFFKPRQPKKLYYQQLKMKITDFENRRSFKCIWLNSQFREEEITLYPDKHGCVRDLLEECKKAVELGEKASGKLRLLEIVSYKIIGVHQEDELLECLSPATSRTFRIEEIPLDQVDIDKENEMLVTVAHFHKEVFGTFGIPFLLRIHQGEHFREVMKRIQSLLDIQEKEFEKFKFAIVMTGRHQYINEDEYEVNLKDFEPQPGNMSHPRPWLGLDHFNKAPKRSRYTYLEKAIKIHN

SEQ ID NO: 1376 - protein, 101 aa, Homo sapiens
  misc_feature (0)...(0): Polypeptide Accession Number Q93068
MSDQEAKPSTEDLGDKKEGEYIKLKVIGQDSSEIHFKVKMTTHLKKLKESYCQRQGVPMNSLRFLFEGQRIADNHTPKELGMEEEDVIEVYQEQTGGHSTV

SEQ ID NO: 1377 - protein, 2124 aa, Homo sapiens
  misc_feature (0)...(0): Polypeptide Accession Number Q93074
DEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQRSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 1378 - protein, 610 aa, Homo sapiens
  misc_feature (0)...(0): Polypeptide Accession Number Q99102
TSSVSTGHATSLPVTDTSSASTSHATSLPVTDTSSASTSHATSLLVTDASSVSTGDTTPLPVTDTSSASTGDTTPLHVTDASSVSTGHATPLHVTSLSSVSTGDTTPLPVTSPSSASSGHATSLPVTDASSLSTGHATSLHVTDASSVSTGHATLLHVTDASSASTGHTTSLPVTDASSVSTGDTTPLPVTDTSSASTGDTTPLHVTDASSVSTGHATPLHVTSLSSVSTGDTTPLPVTSPSSASSGHATSLPVTDASSVSTGHATSLPVTIPSSASSGDATSLPVTSLSSLSTGHATPLPVTSLSSASTGHATPLPVTDTSSVSTGHATSLLVTDASSVSTGHATPLHVTDASSVSTGDTTPLPVTSPSSASTGDTTPLPVTDTSSVSTGDTTPLLVTDTSSVSTSHATSLPVTDTSSVSTSHATSLPVTDPSSASTGDTTPLPVTDTSSVSTSHATSLPVTDTSSASTSHATSLPVTDTSSASTGHATPLPVTDTSSASTGHATPLLVTDTSSASTGHTTPLHVTSPSSASTGHATPLPVTSPSSASTSHATSLPVTDTSSASTGHATPLLVTDTSSASTGHATPLLVTDTSSASTGHATPLPVTDTS

SEQ ID NO: 1379 - protein, 191 aa, Homo sapiens
  misc_feature (0)...(0): Polypeptide Accession Number Q99217
MGTWILFACLLGAAFAMPLPPHPGHPGYINFSYEVLTPLKWYQSIRPPYPSYGYEPMGGWLHHQIIPVLSQQHPPTHTLQPHHHIPVVPAQQPVIPQQPMMPVPGQHSMTPIQHHQPNLPPPAQQPYQPQPVQPQPHQPMQPQPPVHPMQPLPPQPPLPPMFPMQPLPPMLPDLTLEAWPSTDKTKREEVD

SEQ ID NO: 1380 - protein, 400 aa, Homo sapiens
  misc_feature (0)...(0): Polypeptide Accession Number Q99418
MEDGVYEPPDLTPEERMELENIRRRKQELLVEIQRLREELSEAMSEVEGLEANEGSKTLQRNRKMAMGRKKFNMDPKKGIQFLVENELLQNTPEEIARFLYKGEGLNKTAIGDYLGEREELNLAVLHAFVDLHEFTDLNLVQALRQFLWSFRLPGEAQKIDRMMEAFAQRYCLCNPGVFQSTDTCYVLSFAVIMLNTSLHNPNVRDKPGLERFVAMNRGINEGGDLPEELLRNLYDSIRNEPFKIPEDDGNDLTHTFFNPDREGWLLKLGGGRVKTWKRRWFILTDNCLYYFEYTTDKEPRGIIPLENLSIREVDDPRKPNCFELYIPNNKGQLIKACKTEADGRVVEGNHMVYRISAPTQEEKDEWIKSIQAAVSVDPFYEMLAARKKRISVKKKQEQP

SEQ ID NO: 1381 - protein, 506 aa, Homo sapiens [sequence omitted]

SEQ ID NO: 1382 - protein, 170 aa, Homo sapiens
  misc_feature (0)...(0): Polypeptide Accession Number Q99462
MTELQSALLLRRQLAELNKNPVEGFSAGLIDDNDLYRWEVLIIGPPDTLYEGGVFKAHLTFPKDYPLRPPKMKFITEIWHPNVDKNGDVCISILHEPGEDKYGYEKPEERWLPIHTVETIMISVISMLADPNGDSPANVDAAKEWREDRNGEFKRKVARCVRKSQETAFE

SEQ ID NO: 1383 - protein, 154 aa, Homo sapiens
  misc_feature (0)...(0): Polypeptide Accession Number Q99471
MAQSINITELNLPQLEMLKNQLDQEVEFLSTSIAQLKVVQTKYVEAKDCLNVLNKSNEGKELLVPLTSSMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 1384 - protein, 375 aa, Homo sapiens
  misc_feature (0)...(0): Polypeptide Accession Number Q99733
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLDEDSEFTLASDFEIGHFFRERIVPRAVLYFTGEAIEDDDNFEEGEEGEEEELEGDEEGEDEDDAEINPKV

SEQ ID NO: 1385 - protein, 626 aa, Homo sapiens
  misc_feature (0)...(0): Polypeptide Accession Number Q99759
MDEQEALNSIMNDLVALQMNRRHRMPGYETMKNKDTGHSNRQSDVRIKFEHNGERRIIAFSRPVKYEDVEHKVTTVFGQPLDLHYMNNELSILLKNQDDLDKAIDILDRSSSMKSLRILLLSQDRNHNSSSPHSEVSRQVRIKASQSAGDINTIYQPPEPRSRHLSVSSQNPGRSSPPPGYVPERQQHIARQGSYTSINSEGEFIPETSEQCMLDPLSSAENSLSGSCQSLDRSADSPSFRKSRMSRAQSFPDNRQEYSDRETQLYDKGVKGGTYPRRYHVSVHHKDYSDGRRTFPRIRRHQGNLFTLVPSSRSLSTNGENMGLAVQYLDPRGRLRSADSENALSVQERNVPTKSPSAPINWRRGKLLGQGAFGRVYLCYDVDTGRELASKQVQFDPDSPETSKEVSALECEIQLLKNLQHERIVQYYGCLRDRAEKTLTIFMEYMPGGSVKDQLKAYGALTESVTRKYTRQILEGMSYLHSNMIVHRDIKGANILRDSAGNVKLGDFGASKRLQTICMSGTGMRSVTGTPYWMSPEVISGEGYGRKADVWSLGCTVVEMLTEKPPWAEYEAMAAIFKIATQPTNPQLPSHISEHGRDFLRRIFVEARQRPSAEELLTHHFAQLMY

SEQ ID NO: 1386 - protein, 325 aa, Homo sapiens
  misc_feature (0)...(0): Polypeptide Accession Number P52745
RNEGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGPREKGKGLGRSFSLSSNFTTPEEVPTGTKSHRCDECGKCFTRSSSLIRHKIIHTGEKPYECSECGKAFSLNSNLVLHQRIHTGEKPHECNECGKAFSHSSNLILHQRIHSGEKPYECNECGKAFSQSSDLTKHQRIHTGEKPYECSECGKAFNRNSYLILHRRIHTREKPYKCTKCGKAFTRSSTLTLHHRIHARERASEYSPASLDAFGAFLKSCV

SEQ ID NO: 1387 - protein, 115 aa, Homo sapiens [sequence omitted]

We claim:

1. A purified protein complex comprising a first polypeptide and a second polypeptide, wherein said complex comprises the amino acid sequences of a first polypeptide (SMI1, SEQ ID NO: 359), and a second polypeptide (BAS1, SEQ ID NO: 518), denoted as ProPair 267a–267b.

2. The complex of claim 1, wherein said second polypeptide is labeled with a detectable substance.

3. The complex of claim 1, wherein said second polypeptide is labeled with a detectable substance.

4. The complex of claim 2, wherein said second polypeptide is labeled with a detectable substance.

5. A composition comprising the complex of claim 1 and a pharmaceutically acceptable carrier.

* * * * *

UNITED STATES PATENT AND TRADEMARK OFFICE
CERTIFICATE OF CORRECTION

PATENT NO.    : 6,753,314 B1  
DATED         : June 22, 2004  
INVENTOR(S)   : Loic Giot and Traci Mansfield It is certified that error appears in the above-identified patent and that said Letters Patent is hereby corrected as shown below:

<u>Column 125,</u>  
Line 20, that portion of the claim reading "second" should read -- first --.

Signed and Sealed this

Fifth Day of April, 2005

JON W. DUDAS  
*Director of the United States Patent and Trademark Office*